(12) United States Patent
Feinstein et al.

(10) Patent No.: US 9,487,778 B2
(45) Date of Patent: Nov. 8, 2016

(54) OLIGONUCLEOTIDE MODULATORS OF THE TOLL-LIKE RECEPTOR PATHWAY

(75) Inventors: Elena Feinstein, Rehovot (IL); Svetlana Adamsky, Gedera (IL); Sharon Avkin-Nachum, Nes Zionna (IL); Hagar Kalinski, Rishon-Le-Zion (IL); Igor Mett, Rehovot (IL)

(73) Assignee: QUARK PHARMACEUTICALS, INC.

( * ) Notice: Subject to any disclaimer, the term of this patent is extended or adjusted under 35 U.S.C. 154(b) by 168 days.

(21) Appl. No.: 14/002,901

(22) PCT Filed: Mar. 1, 2012

(86) PCT No.: PCT/US2012/027174
§ 371 (c)(1),
(2), (4) Date: Oct. 3, 2013

(87) PCT Pub. No.: WO2012/118911
PCT Pub. Date: Sep. 7, 2012

(65) Prior Publication Data
US 2014/0329878 A1    Nov. 6, 2014

Related U.S. Application Data

(60) Provisional application No. 61/448,707, filed on Mar. 3, 2011.

(51) Int. Cl.
*C12N 15/11* (2006.01)
*C12N 15/113* (2010.01)

(52) U.S. Cl.
CPC ......... *C12N 15/113* (2013.01); *C12N 15/1138* (2013.01); *C12N 2310/14* (2013.01); *C12N 2310/321* (2013.01)

(58) Field of Classification Search
CPC ............. C12N 15/111; C12N 15/113; C12N 15/1138; A61K 31/713
See application file for complete search history.

(56) References Cited

U.S. PATENT DOCUMENTS

| | | |
|---|---|---|
| 4,439,196 A | 3/1984 | Higuchi |
| 4,447,224 A | 5/1984 | DeCant, Jr. et al. |
| 4,447,233 A | 5/1984 | Mayfield |
| 4,475,196 A | 10/1984 | La Zor |
| 4,486,194 A | 12/1984 | Ferrara |
| 4,487,603 A | 12/1984 | Harris |
| 4,666,828 A | 5/1987 | Gusella |
| 4,683,202 A | 7/1987 | Mullis |
| 4,801,531 A | 1/1989 | Frossard |
| 4,959,217 A | 9/1990 | Sanders et al. |
| 5,167,616 A | 12/1992 | Haak et al. |
| 5,169,383 A | 12/1992 | Gyory et al. |
| 5,192,659 A | 3/1993 | Simons |
| 5,225,182 A | 7/1993 | Sharma |
| 5,272,057 A | 12/1993 | Smulson et al. |
| 5,580,859 A | 12/1996 | Felgner et al. |
| 5,589,466 A | 12/1996 | Felgner et al. |
| 5,593,972 A | 1/1997 | Weiner et al. |
| 5,898,031 A | 4/1999 | Crooke |
| 6,107,094 A | 8/2000 | Crooke |
| 6,121,426 A | 9/2000 | Vogel et al. |
| 6,693,187 B1 | 2/2004 | Dellinger |
| 7,067,641 B2 | 6/2006 | Dellinger |
| 8,796,239 B2* | 8/2014 | Avkin-Nachum .... C12N 15/111 435/6.1 |
| 2004/0019001 A1 | 1/2004 | McSwiggen |
| 2004/0063654 A1 | 4/2004 | Davis et al. |
| 2005/0004064 A1 | 1/2005 | Tei et al. |
| 2006/0058255 A1* | 3/2006 | Chen ............ C12N 15/111 514/44 A |
| 2008/0293655 A1 | 11/2008 | Aygun et al. |
| 2009/0162365 A1 | 6/2009 | Feinstein et al. |
| 2010/0292301 A1 | 11/2010 | Feinstein et al. |
| 2011/0112168 A1 | 5/2011 | Feinstein et al. |

FOREIGN PATENT DOCUMENTS

| | | |
|---|---|---|
| WO | 9323569 A1 | 11/1993 |
| WO | 9839352 A1 | 9/1998 |
| WO | 9914226 A2 | 3/1999 |
| WO | 9932619 A1 | 7/1999 |
| WO | 0044895 A1 | 8/2000 |
| WO | 0044914 A1 | 8/2000 |
| WO | 0047599 A1 | 8/2000 |
| WO | 0049035 A1 | 8/2000 |
| WO | 0063364 A2 | 10/2000 |
| WO | 0129058 A1 | 4/2001 |
| WO | 0136641 A2 | 5/2001 |
| WO | 0136646 A1 | 5/2001 |
| WO | 0175164 A2 | 10/2001 |
| WO | 0244321 A2 | 6/2002 |
| WO | 2004015107 A2 | 2/2004 |
| WO | 2004041924 A2 | 5/2004 |
| WO | 2004083430 A2 | 9/2004 |
| WO | 2004/093778 A2 | 11/2004 |
| WO | 2006047842 A2 | 5/2006 |
| WO | 2007/041218 A2 | 4/2007 |
| WO | 2007091266 A2 | 8/2007 |
| WO | 2008132723 A2 | 11/2008 |
| WO | 2009/000929 A2 | 12/2008 |
| WO | 2009015107 A1 | 1/2009 |
| WO | 2010/053971 A1 | 5/2010 |
| WO | 2010/144336 A2 | 12/2010 |
| WO | 2001066475 A1 | 6/2011 |
| WO | 2011084193 A1 | 7/2011 |
| WO | 2011085056 A1 | 7/2011 |

OTHER PUBLICATIONS

International Search Report and Written Opinion issued in PCT/US2012/027174 on Aug. 21, 2012.

(Continued)

*Primary Examiner* — Jon E Angell
(74) *Attorney, Agent, or Firm* — Nutter McClennen & Fish LLP; Konstantin Linnik; Isaac A. Hubner

(57) ABSTRACT

Disclosed herein are double stranded nucleic acid molecules and pharmaceutical compositions comprising same useful in the treatment of, inter alia, acute and chronic inflammation, neuropathic pain, primary graft dysfunction (PGD) after lung transplantation in a subject in need thereof. The compounds are preferably chemically synthesized and modified dsRNA compounds, which down regulate or inhibit expression of a Toll like receptor genes.

16 Claims, No Drawings

(56) References Cited

OTHER PUBLICATIONS

Allart et al., 1,5-Anhydro-2-Deoxy-D-Altritol Oligonucleotides as Conformationally Restricted Analogues of Rna. Nucleosides & Nucleotides 1998;17:1523-1526.
AMBROS, The functions of animal microRNAs. Nature. Sep. 16, 2004;431(7006):350-355.
Barik, Silence of the transcripts: RNA interference in medicine. J Mol Med (Berl). Oct. 2005;83(10):764-773.
Bartel, MicroRNAs: genomics, biogenesis, mechanism, and function. Cell. Jan. 23, 2004;116(2):281-297.
Bellon et al., Amino-Linked Ribozymes: Post-Synthetic Conjugation of Half-Ribozymes. Nucleosides & Nucleotides 1997;16:951-954.
Bellon et al., Post-synthetically Ligated Ribozymes: An Alternative Approach to Iterative Solid-Phase Synthesis. Bioconjug Chem. Mar.-Apr. 1997;8(2):204-212.
Bernstein et al., Role for a bidentate ribonuclease in the initiation step of RNA interference. Nature. Jan. 18, 2001;409(6818):363-366.
Bernstein et al., The rest is silence. RNA. Nov. 2001;7(11):1509-21.
Braasch et al., RNA Interference in Mammalian Cells by Chemically-Modified RNA. Biochemistry. Jul. 8, 2003;42 (26):7967-7975.
Caplen et al. Specific inhibition of gene expression by small double-stranded RNAs in invertebrate and vertebrate systems. Proc Natl Acad Sci U S A. Aug. 14, 2001;98(17):9742-9747.
Caruthers et. al., Chemical Synthesis of Deoxyoligonucleotides by the Phosphoramidite Method. Methods Enzymol. 1987;154:287-313.
Chakraborty, Potentiality of Small Interfering RNAS (siRNA) as Recent Therapeutic Targets for Gene-Silencing. Curr Drug Targets. Mar. 2007;8(3):469-482.
Chalk et al., Improved and automated prediction of effective siRNA. Biochem Biophys Res Commun. Jun. 18, 2004;319(1):264-274.
Chiu and Rana, siRNA function in RNAi: a chemical modification analysis. RNA. Sep. 2003;9(9):1034-1048.
Czaudema et al., Structural variations and stabilising modifications of synthetic siRNAs in mammalian cells. Nucleic Acids Res. Jun. 1, 2003;31(11):2705-2716.
Densmore et al., Aerosol Delivery of Robust Polyethyleneimine—DNA Complexes for Gene Therapy and Genetic Immunization. Mol Ther. Feb. 2000;1(2):180-188.
Durcan et al., Inhalable siRNA: Potential as a Therapeutic Agent in the Lungs. Mol Pharm. Jul.-Aug. 2008;5 (4):559-566.
Eckstein, Nucleoside Phosphorothioates. Annu Rev Biochem. 1985;54:367-402.
Elbashir et al., Duplexes of 21-nucleotide RNAs mediate RNA interference in cultured mammalian cells. Nature. May 24, 2001;411(6836):494-498.
Elbashir et al., RNA interference is mediated by 21- and 22-nucleotide RNAs. Genes Dev. Jan. 15, 2001;15 (2):188-200.
Elmen et al., Locked nucleic acid (LNA) mediated improvements in siRNA stability and functionality. Nucleic Acids Res. Jan. 14, 2005;33(1):439-447.
Fire et al, Potent and specific genetic interference by double-stranded RNA in Caenorhabditis elegans. Nature. Feb. 19, 1998;391(6669):806-811.
Fisher et al., Inhibition of MDR1 expression with altritol-modified siRNAs. Nucleic Acids Res. 2007;35(4):1064-1074.
Gautam et al., Transgene Expression in Mouse Airway Epithelium by Aerosol Gene Therapy with PEI—DNA Complexes. Mol Ther. Apr. 2001;3(4):551-556.
Gerhart et al., Health and psychosocial issues of individuals with incomplete and resolving spinal cord injuries. Paraplegia. Apr. 1992;30(4):282-287.
Gil and Esteban, Induction of apoptosis by the dsRNA-dependent protein kinase (PKR): Mechanism of action. Apoptosis. Apr. 2000;5(2):107-114.

Grimm and Kay, Therapeutic application of RNAi: is mRNA targeting finally ready for prime time? J Clin Invest. Dec. 2007;117(12):3633-3641.
Herdewijn et al., Properties of Oligonucleotides with Six Membered Carbohydrate Mimics and a 1,4-Relationship between the Base Moiety and the Hydroxymethyl Group. Nucleosides & Nucleotides 1999;18:1371-1376.
Jensen et al., Unlocked nucleic acid (UNA) and UNA derivatives: Thermal denaturation studies. Nucleic Acids Symp Ser (Oxf). 2008;(52):133-134.
Kim and Chung, An experimental model for peripheral neuropathy produced by segmental spinal nerve ligation in the rat. Pain. Sep. 1992;50(3):355-363.
Kim and Rossi, RNAi mechanisms and applications. Biotechniques. Apr. 2008;44(5):613-616.
Krupnick et al. Orthotopic Mouse Lung Transplantation as Experimental Methodology to Study Transplant and Tumor Biology. Nat Protoc. 2009;4(1):86-93.
Lee and Christie, Primary Graft Dysfunction. Proc Am Thorac Soc. Jan. 15, 2009;6(1):39-46.
Lee et al., The nuclear RNase III Drosha initiates microRNA processing. Nature. Sep. 25, 2003;425(6956):415-419.
Levenkova et al., Gene specific siRNA selector. Bioinformatics. Feb. 12, 2004;20(3):430-432.
Lewis et al., Efficient delivery of siRNA for inhibition of gene expression in postnatal mice. Nat Genet. Sep. 2002;32 (1):107-108.
Li et al., The dendritic cell mannose receptor mediates allergen internalization and maturation involving notch 1 signalling. Clin Exp Immunol. Nov. 2010;162(2):251-261.
McManus and Sharp, Gene Silencing in Mammals by Small Interfering RNAs. Nat Rev Genet. Oct. 2002;3 (10):737-747.
Nishikura, A Short Primer on RNAi: RNA-Directed RNA Polymerase Acts as a Key Catalyst. Cell. Nov. 16, 2001;107 (4):415-418.
Okazaki et al., A Mouse Model of Orthotopic Vascularized Aerated Lung Transplantation. Am J Transplant. Jun. 2007;7(6):1672-1679.
Paddison and Hannon, siRNAs and shRNAs: Skeleton keys to the human genome. Curr Opin Mol Ther. Jun. 2003;5(3):217-224.
Perez-Perez et al., Synthesis and Antiviral Activity of 2-Deoxy-1,5-Anhydro-D-Mannitol Nucleosides Containing a Pyrimidine Base Moiety. Bioorg. and Medicinal Chem Letters 1996;6:1457-1460.
Reich et al., Small interfering RNA (siRNA) targeting VEGF effectively inhibits ocular neovascularization in a mouse model. Mol Vis. May 30, 2003;9:210-216.
Scaringe et al., Chemical synthesis of biologically active oligoribonucleotides using beta-cyanoethyl protected ribonucleoside phosphoramidites. Nucleic Acids Res. Sep. 25, 1990;18(18):5433-5441.
Shabarova et al., Chemical ligation of DNA: the first non-enzymatic assembly of a biologically active gene. Nucleic Acids Res. Aug. 11, 1991;19(15):4247-4251.
Shahiwala and Misra, A Preliminary Pharmacokinetic Study of Liposomal Leuprolide Dry Powder Inhaler: A Technical Note. AAPS PharmSciTech. Oct. 24, 2005;6(3):E482-6.
Shen et al., Gene silencing by adenovirus-delivered siRNA. FEBS Lett. Mar. 27, 2003;539(1-3):111-114.
Siddall et al., A longitudinal study of the prevalence and characteristics of pain in the first 5 years following spinal cord injury. Pain. Jun. 2003;103(3):249-257.
Siddall et al., Pain report and the relationship of pain to physical factors in the first 6 months following spinal cord injury. Pain. May 1999;81(1-2):187-197.
Ajuwon, et al., Stimulation with Peptidoglycan induces interleukin 6 and TLR2 expression and a concomitant downregulation of expression of adiponectin receptors 1 and 2 in 3T3-L1 adipocytes. J Inflamm (Lond). Apr. 6, 2009;6:8 doi: 10.1186/1476-9255-6-8.
Singaporean Search Report for Application No. 201306622-0, mailed Jul. 21, 2015 (7 pages).
Simeoni et al., Insight into the mechanism of the peptide-based gene delivery system MPG: implications for delivery of siRNA into mammalian cells. Nucleic Acids Res. Jun. 1, 2003;31(11):2717-2724.
Sioud and Leirdal, Potential Design Rules and Enzymatic Synthesis of siRNAs. Methods Mol Biol. 2004;252:457-469.

(56) References Cited

OTHER PUBLICATIONS

Song et al., Antibody mediated in vivo delivery of small interfering RNAs via cell-surface receptors. Nat Biotechnol. Jun. 2005;23(6):709-17.

Sorensen et al., Gene Silencing by Systemic Delivery of Synthetic siRNAs in Adult Mice. J Mol Biol. Apr. 4, 2003;327 (4):761-766.

Sved et al., Relationship between surgery and pain following spinal cord injury. Spinal Cord. Aug. 1997;35(8):526-530.

Takei et al., 5'-,3'-Inverted Thymidine-modified Antisense Oligodeoxynucleotide Targeting Midkine. Its Design and Application for Cancer Therapy. J Biol Chem. Jun. 28, 2002;277(26):23800-23806.

Testoni et al., A New Method of "In-Cell Reverse Transcriptase-Polymerase Chain Reaction" for the Detection of BCRIABL Transcript in Chronic Myeloid Leukemia Patients. Blood. May 1, 1996;87(9):3822-3827.

Tolentino et al., Intravitreal Injection of Vascular Endothelial Growth Factor Small Interfering RNA Inhibits Growth and Leakage in a Nonhuman Primate, Laser-Induced Model of Choroidal Neovascularization. Retina. Feb. 2004;24 (1):132-138.

Ui-Tei et al., Essential Notes Regarding the Design of Functional siRNAs for Efficient Mammalian RNAi. J Biomed Biotechnol. 2006;2006(4):65052.

Ui-Tei et al., Functional dissection of siRNA sequence by systematic DNA substitution: modified siRNA with a DNA seed arm is a powerful tool for mammalian gene silencing with significantly reduced off-target effect. Nucleic Acids Res. Apr. 2008;36(7):2136-2151.

Ui-Tei et al., Guidelines for the selection of highly effective siRNA sequences for mammalian and chick RNA interference. Nucleic Acids Res. Feb. 9, 2004;32(3):936-948.

Weiss et al., Perflubron Enhances Adenovirus-Mediated Gene Expression in Lungs of Transgenic Mice with Chronic Alveolar Filling. Hum Gene Ther. Sep. 20, 1999;10(14):2287-2293.

Wincott and Usman, A Practical Method for the Production of RNA and Ribozymes. Methods Mol Biol. 1997;74:59-68.

Wincott et al., Synthesis, deprotection, analysis and purification of RNA and ribozymes. Nucleic Acids Res. Jul. 25, 1995;23(14):2677-2684.

Xia et al., siRNA-mediated gene silencing in vitro and in vivo. Nat Biotechnol. Oct. 2002;20(10):1006-1010.

\* cited by examiner

OLIGONUCLEOTIDE MODULATORS OF THE TOLL-LIKE RECEPTOR PATHWAY

RELATED APPLICATIONS

The present invention is filed under 35 U.S.C. §371 as the U.S. national phase of International Application No. PCT/US2012/027174, filed Mar. 1, 2012, which designated the U.S. and claims the benefit of priority to U.S. Provisional Patent Application No. 61/448,707 filed Mar. 3, 2011 entitled "TLR2, TLR4, MYD88, TICAM1 and TIRAP NUCLEOTIDE INHIBITORS AND METHODS OF USE THEREOF", which is incorporated herein by reference in its entirety and for all purposes.

SEQUENCE LISTING

The instant application contains a Sequence Listing, which is entitled QUARK0006US_SeqListing.txt, created on Sep. 3, 2013 and 3908 kb in size, and is hereby incorporated by reference in its entirety.

FIELD OF THE INVENTION

Provided herein are nucleic acid molecules, pharmaceutical compositions comprising same and methods of use thereof for the inhibition of mammalian target genes TLR2, TLR4, MYD88, TICAM1 and TIRAP in the Toll-like receptor (TLR) pathway. Specific compounds include unmodified and chemically modified dsRNA and siRNA oligonucleotides and compositions comprising same.

BACKGROUND OF THE INVENTION

Oligonucleotide sequences and nucleotide modifications useful in generating dsRNA have been described by the applicants of the present disclosure in, inter alia, US Patent Publication Nos. US 20080293655, US 20090162365, US 20100292301 and US 20110112168 and PCT Patent Publication Nos. WO 2011/066475, WO 2011/084193 and WO 2011/085056, hereby incorporated by reference in their entirety.

There remains a need for active and effective dsRNA therapeutic agents which exhibit enhanced knock down activity, increased stability and/or reduced off target effects useful in modulating the Toll-like receptor pathway.

SUMMARY OF THE INVENTION

Provided herein are compositions, methods and kits useful for modulating expression of target genes in the Toll-like receptor pathway. In various aspects provided are nucleic acid molecule inhibitors of a mammalian gene selected from the group consisting of TLR2, TLR4, MYD88, TICAM1 and TIRAP, having mRNA polynucleotide sequences set forth in SEQ ID NOS: 1-12 which include SEQ ID NO:1 (TLR2 mRNA); SEQ ID NO:2-4 (TLR4 mRNA), SEQ ID NO:5-9 (MYD88 mRNA), SEQ ID NO:10 (TICAM1 mRNA) or SEQ ID NO:11-12 (TIRAP mRNA).

In particular embodiments provided herein are novel double stranded nucleic acid molecules, in particular double-stranded RNA (dsRNA), that inhibit, down-regulate or reduce expression of a gene selected from the group consisting of TLR2, TLR4, MYD88, TICAM1 and TIRAP, and pharmaceutical compositions comprising one or more such oligonucleotides or a vector capable of expressing the oligonucleotide. Further provided herein are methods for treating inflammation and inflammatory diseases and graft rejection associated with organ transplantation, such as lung transplantation, in which expression of one or more of the TLR2, TLR4, MYD88, TICAM1 and TIRAP genes is associated with the etiology or progression of inflammation and graft rejection associated with organ transplantation.

In some aspects and embodiments the double stranded oligonucleotides are chemically modified dsRNA compounds. In some embodiments the dsRNA sense and antisense oligonucleotides are selected from sense oligonucleotides and corresponding antisense oligonucleotides set forth in SEQ ID NOS:13-5846 (targeting TLR2), SEQ ID NOS:5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP).

Accordingly, in one aspect provided herein is a nucleic acid molecule having the following double-stranded Structure:

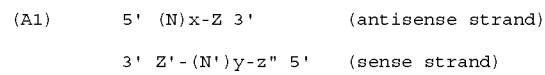

wherein each N and N' is a nucleotide which may be unmodified or modified, or an unconventional moiety;
wherein each of (N)x and (N')y is an oligonucleotide in which each consecutive N or N' is joined to the next N or N' by a covalent bond;
wherein each of Z and Z' is independently present or absent, but if present independently comprises 1-5 consecutive nucleotides or non-nucleotide moieties or a combination thereof covalently attached at the 3' terminus of the strand in which it is present;
wherein z" may be present or absent, but if present is a capping moiety covalently attached at the 5' terminus of (N')y;
wherein each of x and y is independently an integer between 18 and 25;
wherein the sequence of (N')y is complementary to the sequence of (N)x and (N)x includes an antisense sequence to a target RNA set forth in any one of SEQ ID NOS:1-12.

In some embodiments the covalent bond joining each consecutive N or N' is a phosphodiester bond.

In some embodiments x=y and each of x and y is independently 19, 20, 21, 22 or 23. In various embodiments x=y=19.

In some embodiments the sense strand oligonucleotide and the antisense strand oligonucleotide are selected from the oligonucleotide pairs set forth in SEQ ID NOS:13-3060 to target TLR2; SEQ ID NOS:5847-8612 to target TLR4; SEQ ID NOS:12145-13924 to target MYD88; SEQ ID NOS:16333-16882 to target TICAM1; or SEQ ID NOS: 18243-19046 to target TIRAP.

In certain preferred embodiments, the sense strand and the antisense strand of a double-stranded nucleic acid molecule (e.g., a siNA molecule) as disclosed herein include sequences corresponding to any one of the sense sequences and antisense sequences set forth in SEQ ID NOS:13-1448 or 1449-3060 (targeting TLR2); or SEQ ID NOS:5847-8320 or 8321-8612 (targeting TLR4); or SEQ ID NOS:12145-13108 or 13109-13924 (targeting MYD88); or SEQ ID NOS:16333-16866 or 16867-16882 (targeting TICAM1); or SEQ ID NOS:18243-19010 or 19011-19046 (targeting TIRAP).

In some embodiments the sense strand and the antisense strand of a double-stranded nucleic acid molecule are selected from the sequence pairs set forth in TLR2_25, TLR2_28, TLR2_42, TLR2_43 and TLR2_47. In some embodiments the sense strand and the antisense strand are selected from the sequence pairs set forth in TLR2_25 (SEQ ID NOS:20607 and 20614), TLR2_28 (SEQ ID NOS:20608 and 20615), TLR2_42 (SEQ ID NOS:20609 and 20616), TLR2_43 (SEQ ID NOS:20610 and 20617) and TLR2_47 (SEQ ID NOS:20611 and 20618).

In some embodiments the nucleic acid molecule (e.g., a siNA molecule) as disclosed herein include the sequence pair set forth in TLR2_25 (SEQ ID NOS:20607 and 20614). In some embodiments the nucleic acid molecule (e.g., a siNA molecule) as disclosed herein include the sense and antisense strands of the sequence pair set forth in TLR2_28 (SEQ ID NOS:20608 and 20615). In some embodiments the nucleic acid molecule (e.g., a siNA molecule) as disclosed herein includes the sequence pair set forth in TLR2_42 (SEQ ID NOS:20609 and 20616). In some embodiments the nucleic acid molecule (e.g., a siNA molecule) as disclosed herein includes the sense and the antisense strands of the sequence pair set forth in TLR2_43 (SEQ ID NOS:20610 and 20617). In some embodiments the nucleic acid molecule (e.g., a siNA molecule) as disclosed herein includes the sense and the antisense strands of the sequence pair set forth in TLR2_47 (SEQ ID NOS:20611 and 20618).

In some embodiments the sense strand and the antisense strand of a double-stranded nucleic acid molecule are selected from the sequence pairs set forth in TLR4_08, TLR4_10, TLR4_11, TLR4_14, TLR4_15, TLR4_28, TLR4_29, TLR4_31 and TLR4_33. In some embodiments the sense strand and the antisense strand are selected from the sequence pairs set forth in TLR4_08 (SEQ ID NOS: 20621 and 20630), TLR4_10 (SEQ ID NOS:20622 and 20631), TLR4_11 (SEQ ID NOS:20623 and 20632), TLR4_14 (SEQ ID NOS:20624 and 20633), TLR4_15 (SEQ ID NOS:20625 and 20634), TLR4_28 (SEQ ID NOS:20626 and 20635), TLR4_29 (SEQ ID NOS:20627 and 20636), TLR4_31 (SEQ ID NOS:20628 and 20637) and TLR4_33 (SEQ ID NOS:20629 and 20638).

In some embodiments the nucleic acid molecule (e.g., a siNA molecule) as disclosed herein includes the sequence pair set forth in TLR4_08 (SEQ ID NOS:20621 and 20630). In some embodiments the nucleic acid molecule (e.g., a siNA molecule) as disclosed herein includes the sense and the antisense strands of the sequence pair set forth in TLR4_10 (SEQ ID NOS:20622 and 20631). In some embodiments the nucleic acid molecule (e.g., a siNA molecule) as disclosed herein includes the sequence pair set forth in TLR4_11 (SEQ ID NOS:20623 and 20632). In some embodiments the nucleic acid molecule (e.g., a siNA molecule) as disclosed herein includes the sense and the antisense strands of the sequence pair set forth in TLR4_14 (SEQ ID NOS:20624 and 20633). In some embodiments the nucleic acid molecule (e.g., a siNA molecule) as disclosed herein includes the sense and the antisense strands of the sequence pair set forth in TLR4_15 (SEQ ID NOS:20625 and 20634). In some embodiments the nucleic acid molecule (e.g., a siNA molecule) as disclosed herein includes the sequence pair set forth in TLR4_28 (SEQ ID NOS:20626 and 20635). In some embodiments the nucleic acid molecule (e.g., a siNA molecule) as disclosed herein includes the sense and the antisense strands of the sequence pair set forth in TLR4_29 (SEQ ID NOS:20627 and 20636). In some embodiments the nucleic acid molecule (e.g., a siNA molecule) as disclosed herein includes the sequence pair set forth in TLR4_31 (SEQ ID NOS:20628 and 20637). In some embodiments the nucleic acid molecule (e.g., a siNA molecule) as disclosed herein include the sense and the antisense strands of the sequence pair set forth in TLR4_33 (SEQ ID NOS:20629 and 20638).

In some embodiments the sense strand and the antisense strand are selected from the sequence pair set forth in MYD88_11. In some embodiments the antisense strand and the sense strand are selected from the sequence pair set forth in MYD88_11 (SEQ ID NOS:12178 and 12660). In some embodiments the nucleic acid molecule (e.g., a siNA molecule) as disclosed herein includes the sequence pair set forth in MYD88_11 (SEQ ID NOS:12178 and 12660).

In some embodiments the sense strand and the antisense strand are selected from the sequence pair set forth in TICAM1_20. In some embodiments the sense strand and the antisense strand are the sequence pair set forth in TICAM1_20 (SEQ ID NOS:20644 and 20655). In some embodiments the nucleic acid molecule (e.g., a siNA molecule) as disclosed herein includes the sequence pair set forth in TICAM1_20 (SEQ ID NOS:20644 and 20655).

In some embodiments the sense strand and the antisense strand are selected from the sequence pair set forth in TIRAP_16. In some embodiments the antisense strand and the sense strand are selected from the sequence pair set forth in TIRAP_16 (SEQ ID NOS:20661 and 20673). In some embodiments the nucleic acid molecule (e.g., a siNA molecule) as disclosed herein includes the sequence pair set forth in TIRAP_16 (SEQ ID NOS:20661 and 20673).

In various embodiments the double-stranded molecule comprises a mismatch to the target mRNA at the 5' terminal nucleotide of the guide strand (antisense strand).

Accordingly provided are double-stranded nucleic acid molecules having the following Structure:

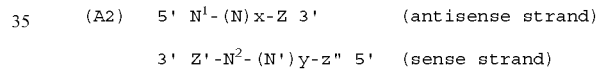

wherein each $N^2$, N and N' is an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is independently an integer between 17 and 24;

wherein the sequence of (N')y is complementary to the sequence of (N)x and (N)x is complementary to a consecutive sequence in a target RNA selected from TLR2, TLR4, MYD88, TICAM, and TIRAP;

wherein $N^1$ is covalently bound to (N)x and is mismatched to a target RNA or is a complementary DNA moiety to the target RNA;

wherein $N^1$ is a moiety selected from the group consisting of unmodified or modified nucleotides selected from uridine (rU), deoxyribouridine (dU), ribothymidine (rT), deoxyribothymidine (dT), adenosine (rA) and deoxyadenosine (dA);

wherein z" may be present or absent, but if present is a capping moiety covalently attached at the 5' terminus of $N^2$-(N')y; and wherein each of Z and Z' is independently present or absent, but if present is independently 1-5 consecutive nucleotides, consecutive non-nucleotide moieties or a combination thereof covalently attached at the 3' terminus of the strand in which it is present.

In some embodiments the sequence of (N')y is fully complementary to the sequence of $(N)_x$. In various embodiments sequence of $N^2$-(N')y is complementary to the sequence of $N^1$-$(N)_x$. In some embodiments $(N)x$ comprises an antisense that is fully complementary to about 17 to about 24 consecutive nucleotides in a target RNA. In other embodiments $(N)x$ comprises an antisense that is substantially complementary to about 17 to about 39 consecutive nucleotides in a target RNA.

In some embodiments $N^1$ and $N^2$ form at least one hydrogen bond. In some embodiments $N^1$ and $N^2$ form a Watson-Crick base pair. In some embodiments $N^1$ and $N^2$ form a non-Watson-Crick base pair. In some embodiments a base pair is formed between a ribonucleotide and a deoxyribonucleotide.

In some embodiments of Structure A2 $x=y=18$, $x=y=19$ or $x=y=20$. In preferred embodiments $x=y=18$.

In some embodiments $N^1$ is covalently bound to $(N)x$ and is mismatched to the target RNA. In various embodiments $N^1$ is covalently bound to $(N)x$ and is a DNA moiety complementary to the target RNA.

In some embodiments $N^1$ is covalently bound to $(N)x$ and is a DNA moiety complementary to the target RNA.

In some embodiments $N^1$ is selected from adenosine, deoxyadenosine, deoxyuridine, ribothymidine or deoxythymidine, and the pairing nucleotide in the target RNA is adenosine. In preferred embodiments $N^1$ selected from adenosine, deoxyadenosine or deoxyuridine.

In some embodiments $N^1$ is selected from adenosine, deoxyadenosine, uridine, deoxyuridine, ribothymidine or deoxythymidine and the pairing nucleotide in the target RNA is cytidine. In preferred embodiments $N^1$ is selected from adenosine, deoxyadenosine, uridine or deoxyuridine.

In some embodiments $N^1$ is selected from an unmodified or modified adenosine, deoxyadenosine, uridine, deoxyuridine, ribothymidine or deoxythymidine and the pairing nucleotide in the target RNA is guanosine. In some embodiments $N^1$ comprises a 2'-OMe sugar modified adenosine, uridine or ribothymidine. In some embodiments $N^1$ comprises a 2' fluoro or 2' amino sugar modified adenosine, uridine or ribothymidine.

In preferred embodiments $N^1$ is selected from adenosine, deoxyadenosine, uridine or deoxyuridine. In some embodiments $N^1$ is selected from adenosine and deoxyadenosine and $N^2$ is uridine and $N^1$ and $N^2$ form a base pair. In some embodiments $N^1$ is selected from uridine or deoxyuridine and $N^2$ is adenosine and $N^1$ and $N^2$ form a base pair.

In some embodiments $N^1$ is selected from deoxyadenosine, deoxyuridine, ribothymidine or deoxythymidine and wherein the nucleotide in the pairing nucleotide in the target RNA is uridine. In preferred embodiments $N^1$ selected from deoxyadenosine or deoxyuridine.

In some embodiments $N^1$ is selected from uridine or deoxyuridine and $N^2$ is selected from adenosine or deoxyadenosine and $N^1$ and $N^2$ form a base pair.

In some embodiments $N^1$ is selected from adenosine or deoxyadenosine and $N^2$ is selected from uridine or deoxyuridine and $N^1$ and $N^2$ form a base pair. In other embodiments $N^1$ is deoxyuridine and $N^2$ is adenosine and $N^1$ and $N^2$ form a base pair. In some embodiments $N^1$ is adenosine and $N^2$ is uridine and $N^1$ and $N^2$ form a base pair.

In some embodiments the sense strand oligonucleotide and the antisense strand oligonucleotide are selected from the oligonucleotide pairs set forth in SEQ ID NOS:3061-5260 or 5261-5846 to target TLR2; SEQ ID NOS:8613-12040 or 12041-12144 to target TLR4; SEQ ID NOS:13925-15910 or 15911-16332 to target MYD88; SEQ ID NOS: 16883-18236 or 18237-18242 to target TICAM1_ or SEQ ID NOS:19047-20590 or 20591-20606 to target TIRAP.

In some embodiments the sense strand and the antisense strand are selected from the sequence pairs set forth in TLR2_31 and TLR2_34. In some embodiments the sense strand and antisense strand are selected from the sequence pairs set forth in TLR2_31 (SEQ ID NOS:20612 and 20619) and TLR2_34 (SEQ ID NOS:20613 and 20620). In various embodiments $N^1$ in the antisense strand includes uridine or chemically modified uridine and $N^2$ in the sense strand includes riboadenine or a chemically modified riboadenine. In some embodiments the nucleic acid molecule (e.g., a siNA molecule) as disclosed herein includes the sequence pair set forth in TLR2_31 (SEQ ID NOS:20612 and 20619). In some embodiments the nucleic acid molecule (e.g., a siNA molecule) as disclosed herein includes the sense and the antisense strands of the sequence pair set forth in TLR2_34 (SEQ ID NOS:20613 and 20620).

In some embodiments the sense strand and the antisense strand are selected from the sequence pairs set forth in TICAM1_15, TICAM1_16, TICAM1_17, TICAM1_18, TICAM1_19, TICAM1_21, TICAM1_22, TICAM1_23, TICAM1_24, and TICAM1_25. In some embodiments the sense strand and the antisense strand are selected from the sequence pairs set forth in TICAM1_15 (SEQ ID NOS: 20639 and 20650), TICAM1_16 (SEQ ID NOS:20640 and 20651), TICAM1_17 (SEQ ID NOS:20641 and 20652), TICAM1_18 (SEQ ID NOS:20642 and 20653); TICAM1_19 (SEQ ID NOS:20643 and 20654); TICAM1_21 (SEQ ID NOS:20645 and 20656), TICAM1_22 (SEQ ID NOS:20646 and 20657), TICAM1_23 (SEQ ID NOS:20647 and 20658), TICAM1_24 (SEQ ID NOS:20448 and 20659) and TICAM1_25 (SEQ ID NOS:20649 and 20660).

In some embodiments the nucleic acid molecule (e.g., a siNA molecule) as disclosed herein includes the sequence pair set forth in TICAM1_15 (SEQ ID NOS:20639 and 20650). In some embodiments the nucleic acid molecule (e.g., a siNA molecule) as disclosed herein includes the sense and the antisense strands of the sequence pair set forth in TICAM1_16 (SEQ ID NOS:20640 and 20651). In some embodiments the nucleic acid molecule (e.g., a siNA molecule) as disclosed herein includes the sequence pair set forth in TICAM1_17 (SEQ ID NOS:20641 and 20652). In some embodiments the nucleic acid molecule (e.g., a siNA molecule) as disclosed herein includes the sense and the antisense strands of the sequence pair set forth in TICAM1_18 (SEQ ID NOS:20642 and 20653). In some embodiments the nucleic acid molecule (e.g., a siNA molecule) as disclosed herein includes the sequence pair set forth in TICAM1_19 (SEQ ID NOS:20643 and 20654). In some embodiments the nucleic acid molecule (e.g., a siNA molecule) as disclosed herein includes the sense and the antisense strands of the sequence pair set forth in TICAM1_21 (SEQ ID NOS:20645 and 20656). In some embodiments the nucleic acid molecule (e.g., a siNA molecule) as disclosed herein includes the sequence pair set forth in TICAM1_22 (SEQ ID NOS:20646 and 20657). In some embodiments the nucleic acid molecule (e.g., a siNA molecule) as disclosed herein includes the sense and the antisense strands of the sequence pair set forth in TICAM1_23 (SEQ ID NOS:20647 and 20658). In some embodiments the nucleic acid molecule (e.g., a siNA molecule) as disclosed herein includes the sequence pair set forth in TICAM1_24 (SEQ ID NOS:20448 and 20659). In some embodiments the nucleic acid molecule (e.g., a siNA molecule) as disclosed herein includes the sense and the antisense strands of the sequence pair set forth in TICAM1_25 (SEQ ID NOS:20649 and 20660).

In some embodiments the sense strand and the antisense strand are selected from the sequence pairs set forth in TIRAP_17, TIRAP_18, TIRAP_19, TIRAP_20, TIRAP_21, TIRAP_22, TIRAP_23, TIRAP_24, TIRAP_25, TIRAP_26 and TIRAP_27. In some embodiments the sense strand and the antisense strand are selected from the sequence pairs set forth in TIRAP_17 (SEQ ID NOS:20662 and 20674), TIRAP_18 (SEQ ID NOS:20663 and 20675); TIRAP_19 (SEQ ID NOS:20664 and 20676); TIRAP_20 (SEQ ID NOS:20665 and 20677), TIRAP_21 (SEQ ID NOS:20666 and 20678), TIRAP_22 (SEQ ID NOS:20667 and 20679), TIRAP_23 (SEQ ID NOS:20668 and 20680), TIRAP_24 (SEQ ID NOS:20669 and 20681), TIRAP_25 (SEQ ID NOS:20670 and 20682), TIRAP_26 (SEQ ID NOS:20671 and 20683) and TIRAP_27 (SEQ ID NOS:20672 and 20684).

In some embodiments the nucleic acid molecule (e.g., a siNA molecule) as disclosed herein includes the sequence pair set forth in TIRAP_17 (SEQ ID NOS:20662 and 20674). In some embodiments the nucleic acid molecule (e.g., a siNA molecule) as disclosed herein includes the sense and the antisense strands of the sequence pair set forth in TIRAP_18 (SEQ ID NOS:20663 and 20675). In some embodiments the nucleic acid molecule (e.g., a siNA molecule) as disclosed herein includes the sequence pair set forth in TIRAP_19 (SEQ ID NOS:20664 and 20676). In some embodiments the nucleic acid molecule (e.g., a siNA molecule) as disclosed herein includes the sense and the antisense strands of the sequence pair set forth in TIRAP_20 (SEQ ID NOS:20665 and 20677). In some embodiments the nucleic acid molecule (e.g., a siNA molecule) as disclosed herein includes the sequence pair set forth in TIRAP_21 (SEQ ID NOS:20666 and 20678). In some embodiments the nucleic acid molecule (e.g., a siNA molecule) as disclosed herein includes the sense and the antisense strands of the sequence pair set forth in TIRAP_22 (SEQ ID NOS:20667 and 20679). In some embodiments the nucleic acid molecule (e.g., a siNA molecule) as disclosed herein includes the sequence pair set forth in TIRAP_23 (SEQ ID NOS:20668 and 20680). In some embodiments the nucleic acid molecule (e.g., a siNA molecule) as disclosed herein includes the sense and the antisense strands of the sequence pair set forth in TIRAP_24 (SEQ ID NOS:20669 and 20681). In some embodiments the nucleic acid molecule (e.g., a siNA molecule) as disclosed herein includes the sequence pair set forth in TIRAP_25 (SEQ ID NOS:20670 and 20682). In some embodiments the nucleic acid molecule (e.g., a siNA molecule) as disclosed herein includes the sense and the antisense strands of the sequence pair set forth in TIRAP_26 (SEQ ID NOS:20671 and 20683). In some embodiments the nucleic acid molecule (e.g., a siNA molecule) as disclosed herein includes the sense and the antisense strands of the sequence pair set forth in TIRAP_27 (SEQ ID NOS:20672 and 20684).

In various embodiments the double stranded nucleic acid molecules are generated based on the SEQ ID NOS:13-5846 (targeting TLR2), SEQ ID NOS:5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP) or preferably oligonucleotide pairs set forth in Tables 1-5, infra, and include one or more of the following modifications according to Structure (A1) and Structure (A2):

a. (N)x=19 or $N^1$-(N)x=19 and in at least one of positions 5, 6, 7, 8, or 9 from the 5' terminus of (N)x or $N^1$-(N)x is selected from a threose nucleic acid (TNA) moiety, a 2'5' nucleotide, a mirror nucleotide, a UNA or an abasic moiety;

b. (N)x=19 or $N^1$-(N)x=19 at least one of the pyrimidine ribonucleotides in (N)x or $N^1$-(N)x comprises a 2' sugar modified ribonucleotide;

c. in (N)x or $N^1$-(N)x, N in positions 11, 13, 15, 17 and 19 comprises 2'-OMe sugar modified ribonucleotides and N in positions 10, 12, 14, 16, and 18 comprises unmodified ribonucleotides;

d. in (N)x or $N^1$-(N)x, N in positions 1, 3, 5, 9, 11, 13, 15, 17 and 19 comprises 2'-OMe sugar modified ribonucleotides and N in positions 2, 4, 6, 8, 10, 12, 14, 16, and 18 comprises unmodified ribonucleotides;

e. in (N)x or $N^1$-(N)x, N in positions 2, 4, 6, 8, 11, 13, 15, 17 and 19 comprises 2'-OMe sugar modified ribonucleotides;

f. Z is covalently attached to the 3' terminus of (N)x or $N^1$-(N)x and includes a non-nucleotide moiety selected from the group consisting of C3OH, C3Pi, C3Pi-C3OH, and C3Pi-C3Pi;

g. N' in at least one of positions 7, 8, 9 or 10 from the 5' terminus of (N')y or $N^2$-(N')y is selected from a threose nucleic acid moiety, a 2'5' nucleotide and pseudoUridine;

h. N' comprises a threose nucleic acid (TNA) moiety or a 2'5' nucleotide in 4, 5, or 6 consecutive positions at the 3' terminal or 3' penultimate positions in (N')y or $N^2$-(N')y;

i. at least one of the pyrimidine ribonucleotides in (N')y or $N^2$-(N')y is a 2' sugar modified ribonucleotide;

j. z" is a cap moiety covalently attached to the 5' terminus of (N')y or $N^2$-(N')y and is selected from an inverted abasic deoxyribose moiety, and inverted abasic ribose moiety, an abasic deoxyribose moiety, an abasic ribose moiety, a C3 moiety as defined hereinbelow, L-DNA, L-RNA;

k. Z' is covalently attached to the 3' terminus of (N')y or $N^2$-(N')y and includes one of C3OH, C3Pi, C3Pi-C3OH, or C3Pi-C3Pi.

In preferred embodiments x=y=19.

In some embodiments the covalent bond joining each consecutive N or N' is a phosphodiester bond. In various embodiments all the covalent bonds are phosphodiester bonds In some embodiments of the double stranded nucleic acid molecules of Structure A1 and Structure A2, N in at least one of positions 5, 6, 7, 8, or 9 from the 5' terminus of the antisense strand [(N)x or $N^1$-(N)x] is selected from a threose nucleic acid (TNA) moiety, a 2'5' nucleotide, a mirror nucleotide, a UNA or a combination thereof. Without wishing to be bound to theory, a double stranded nucleic acid molecule having a threose nucleic acid (TNA) moiety, a 2'5' nucleotide, a mirror nucleotide at any one or more of the aforementioned positions confers to the double stranded molecule increased on-target activity and/or decreased off-target activity and or increased stability to nucleases.

In some embodiments the antisense strand [(N)x of Structure A1 or $N^1$-(N)x of Structure A2] comprises a TNA moiety in position 5, a TNA moiety in position 6, a TNA moiety in position 7, a TNA moiety in position 8, a TNA moiety in position 9, TNA moieties in positions 5-6, TNA moieties in positions 6-7, TNA moieties in positions 7-8, TNA moieties in positions 8-9, TNA moieties in positions 5-7, TNA moieties in positions 6-8, TNA moieties in positions 7-9, TNA moieties in positions 5-8, TNA moieties in positions 6-9 or TNA moieties in positions 5-9.

In some embodiments the antisense strand [(N)x of Structure A1 or N¹-(N)x of Structure A2] comprises a 2'-5' nucleotide in position 5, a 2'-5' nucleotide in position 6, a 2'-5' nucleotide in position 7, a 2'-5' nucleotide in position 8, a 2'-5' nucleotide in position 9, 2'-5' nucleotides in positions 5-6, 2'-5' nucleotides in positions 6-7, 2'-5' nucleotides in positions 7-8, 2'-5' nucleotide in positions 8-9, 2'-5' nucleotides in positions 5-7, 2'-5' nucleotides in positions 6-8, 2'-5' nucleotides in positions 7-9, 2'-5' nucleotides in positions 5-8, 2'-5' nucleotides in positions 6-9 or 2'-5' nucleotides in positions 5-9.

In some embodiments the antisense strand [(N)x of Structure A1 or N¹-(N)x of Structure A2] comprises a mirror nucleotide in position 5, a mirror nucleotide in position 6, a mirror nucleotide in position 7, a mirror nucleotide in position 8, a mirror nucleotide in position 9, mirror nucleotides in positions 5-6, mirror nucleotides in positions 6-7, mirror nucleotides in positions 7-8, mirror nucleotides in positions 8-9, mirror nucleotides in positions 5-7, mirror nucleotides in positions 6-8, mirror nucleotides in positions 7-9, mirror nucleotides in positions 5-8, mirror nucleotides in positions 6-9 or mirror nucleotides in positions 5-9. In some embodiments the mirror nucleotide comprises L-DNA or L-RNA.

In some embodiments of the double stranded nucleic acid molecules, N' in at least one of positions 9 or 10 from the 5' terminus of the sense strand [(N')y in Structure A1 or N²-(N')y in Structure A2] is selected from a threose nucleic acid (TNA) moiety, a 2'5' nucleotide, a pseudoUridine or a combination thereof. Without wishing to be bound to theory, a double stranded nucleic acid molecule having a threose nucleic acid (TNA) moiety, a 2'5' nucleotide, a pseudoUridine at any one or more of positions 9 or 10 in the sense (passenger) strand confers to the double stranded molecule increased on target activity and/or increased nuclease stability.

In some embodiments (N')y in Structure A1 or N²-(N')y in Structure A2 comprises a threose nucleic acid (TNA) moiety in position 9 and/or in position 10.

In some embodiments (N')y in Structure A1 or N²-(N')y in Structure A2 comprises a 2'5' nucleotide in position 9 and/or in position 10.

In some embodiments (N')y in Structure A1 or N²-(N')y in Structure A2 comprises a pseudoUridine in position 9 and/or in position 10.

In some embodiments of the double stranded nucleic acid molecules, N' comprises 4, 5, or 6 consecutive 2'5' nucleotides at the 3' terminal or penultimate position of the sense strand [(N')y in Structure A1 or N²-(N')y in Structure A2]. Without wishing to be bound to theory, a double stranded nucleic acid molecule having 4, 5, or 6 consecutive 2'5' nucleotides at the 3' terminal or penultimate position of the sense (passenger) strand confers increased nuclease stability to the duplex and or reduced off target effect of the sense (passenger) strand. In some embodiments the sense strand further comprises Z'. In some embodiments Z comprises a C3 moiety (for example C3Pi, C3-OH) or a 3' terminal phosphate (Pi).

In some embodiments of Structure A1 and A2 the sense strand comprises four consecutive 2'5' nucleotides at the 3' terminal or penultimate position. In some embodiments of Structure A1 x=y=19 and (N')y comprises 2'5' nucleotides in positions 15, 16, 17, and 18 or in positions 16, 17, 18, and 19. In some embodiments of Structure A2 x=y=18 and N2-(N')y comprises 2'5' nucleotides in positions 15, 16, 17, and 18 or in positions 16, 17, 18, and 19.

In some embodiments of Structures A1 and A2 the sense strand comprises five consecutive 2'5' nucleotides at the 3' terminal or penultimate position. In some embodiments of Structure A1 x=y=19 and (N')y comprises 2'5' nucleotides in positions 14, 15, 16, 17, and 18 or in positions 15, 16, 17, 18, and 19. In some embodiments of Structure A2 x=y=18 and N2-(N')y comprises 2'5' nucleotides in positions 14, 15, 16, 17, and 18 or in positions 15, 16, 17, 18 and N2.

In some embodiments of Structures A1 and A2 the sense strand comprises six consecutive 2'5' nucleotides at the 3' terminal or penultimate position. In some embodiments of Structure A1 x=y=19 and (N')y comprises 2'5' nucleotides in positions 13, 14, 15, 16, 17, and 18 or in positions 14, 15, 16, 17, 18, and 19. In some embodiments of Structure A2 x=y=18 and N2-(N')y comprises 2'5' nucleotides in positions 13, 14, 15, 16, 17, and 18 or in position 14, 15, 16, 17, 18, and N2.

In some embodiments x=y=19 and the double stranded nucleic acid molecule comprises N in at least one of positions 5, 6, 7, 8, or 9 from the 5' terminus of the antisense strand is selected from a threose nucleic acid moiety, a 2'5' nucleotide or a mirror nucleotide;

N' in at least one of positions 9 or 10 from the 5' terminus of the sense strand is selected from a threose nucleic acid moiety, a 2'5' nucleotide and a pseudoUridine; and At least one pyrimidine ribonucleotide in the antisense strand is a 2'-OMe sugar modified ribonucleotide.

In some embodiments the double stranded molecule comprises a 2'5' nucleotide in position 9 of the antisense strand and a 2'5' nucleotide in position 5 or 6 in the sense strand. In additional embodiments the antisense strand further includes 2'-OMe modified pyrimidine ribonucleotides.

In another embodiment x=y=19 and a double stranded nucleic acid molecule comprises N in at least one of positions 5, 6, 7, 8, or 9 from the 5' terminus of the antisense strand is selected from a threose nucleic acid moiety, a 2'5' nucleotide or a mirror nucleotide; and N' in 4, 5, or 6 consecutive positions starting at the 3' terminal or penultimate position of the sense strand comprises a 2'5' nucleotide.

In some embodiments the double stranded nucleic acid molecule is a double stranded oligonucleotide including dsRNA, siRNA, siNA or a miRNA. In some embodiments (N)x and (N')y comprise oligonucleotide pairs set forth in SEQ ID NOS:13-5846 (targeting TLR2), SEQ ID NOS: 5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP) and preferably include one of the following pairs of sense and antisense strands set forth in TLR2_25 (SEQ ID NOS:20607 and 20614), TLR2_28 (SEQ ID NOS:20608 and 20615), TLR2_42 (SEQ ID NOS:20609 and 20616), TLR2_43 (SEQ ID NOS:20610 and 20617), TLR2_47 (SEQ ID NOS:20611 and 20618), TLR2_31 (SEQ ID NOS:20612 and 20619), TLR2_34 (SEQ ID NOS:20613 and 20620); or TLR4_08 (SEQ ID NOS:20621 and 20630), TLR4_10 (SEQ ID NOS:20622 and 20631), TLR4_11 (SEQ ID NOS: 20623 and 20632), TLR4_14 (SEQ ID NOS:20624 and 20633), TLR4_15 (SEQ ID NOS:20625 and 20634), TLR4_28 (SEQ ID NOS:20626 and 20635), TLR4_29 (SEQ ID NOS:20627 and 20636), TLR4_31 (SEQ ID NOS:20628 and 20637), TLR4_33 (SEQ ID NOS:20629 and 20638); or MYD88_11 (SEQ ID NOS:12178 and 12660); or TICAM1_20 (SEQ ID NOS:20644 and 20655), TICAM1_15 (SEQ ID NOS:20639 and 20650), TICAM1_16 (SEQ ID NOS:20640 and 20651), TICAM1_17 (SEQ ID NOS:20641 and 20652), TICAM1_18 (SEQ ID NOS:20642 and 20653); TICAM1_19 (SEQ ID NOS:20643 and 20654); TICAM1_21 (SEQ ID NOS:20645 and 20656), TICAM1_22 (SEQ ID NOS:20646 and 20657), TICAM1_23 (SEQ ID NOS:20647 and 20658), TICAM1_24 (SEQ ID NOS:20448 and 20659), TICAM1_25 (SEQ ID NOS:20649 and 20660); or TIRAP_16 (SEQ ID NOS:20661 and 20673), TIRAP_17 (SEQ ID NOS:20662 and 20674), TIRAP_18 (SEQ ID NOS:20663 and 20675); TIRAP_19 (SEQ ID NOS:20664 and 20676); TIRAP_20 (SEQ ID NOS:20665 and 20677), TIRAP_21 (SEQ ID NOS:20666 and 20678), TIRAP_22 (SEQ ID NOS:20667 and 20679), TIRAP_23 (SEQ ID NOS:20668 and 20680), TIRAP_24 (SEQ ID NOS:20669 and 20681), TIRAP_25 (SEQ ID NOS:20670 and 20682), TIRAP_26 (SEQ ID NOS:20671 and 20683) and TIRAP_27 (SEQ ID NOS:20672 and 20684).

In some embodiments the double stranded molecule comprises a phosphodiester bond. In various embodiments the double stranded molecule comprises ribonucleotides wherein x=y and wherein x is an integer selected from the group consisting of 19, 20, 21, 22, and 23. In some embodiments x=y=19.

In some embodiments (N)x of Structure 1 or N1-(N)x of Structure A2 comprise unmodified ribonucleotides.

In some embodiments (N)x of Structure 1 or N1-(N)x of Structure A2 comprise modified and unmodified ribonucleotides, each modified ribonucleotide a 2'-OMe sugar modified ribonucleotide, wherein N at the 3' terminus of (N)x is a modified ribonucleotide, (N)x comprises at least five alternating modified ribonucleotides beginning at the 3' end and at least nine modified ribonucleotides in total and each remaining N is an unmodified ribonucleotide. In additional embodiments (N)x comprises modified ribonucleotides in alternating positions wherein each N at the 5' and 3' termini are 2'-OMe sugar modified ribonucleotides and the middle ribonucleotide is not modified, e.g. ribonucleotide in position 10 in a 19-mer strand.

In some embodiments (N)x of Structure 1 or N1-(N)x of Structure A2 consist of single alternating 2'-O methyl (2'-OMe) sugar modified and unmodified ribonucleotides, for example wherein the ribonucleotides at positions 1, 3, 5, 7, 9, 11, 13, 15, 17, and 19 are 2'-OMe sugar modified ribonucleotides. In other embodiments the ribonucleotides at positions 2, 4, 6, 8, 11, 13, 15, 17, and 19 are 2'-OMe sugar modified ribonucleotides and the remaining ribonucleotides are unmodified.

In some embodiments (N')y in Structure A1 or N2-(N')y in Structure A2 comprise at least one unconventional moiety selected from a mirror nucleotide, or a nucleotide joined to an adjacent nucleotide by a 2'-5' internucleotide phosphate bond.

In one embodiment of the above Structure, the compound comprises at least one mirror nucleotide at one or both termini in (N')y in Structure A1 or N2-(N')y in Structure A2. In various embodiments the compound comprises two consecutive mirror nucleotides, one at the 3' penultimate position and one at the 3' terminus in (N')y in Structure A1 or N2-(N')y in Structure A2. In one preferred embodiment x=y=19 and (N')y in Structure A1 or N2-(N')y in Structure A2 comprise an L-deoxyribonucleotide at position 18.

In some embodiments the mirror nucleotide is selected from an L-ribonucleotide and an L-deoxyribonucleotide. In various embodiments the mirror nucleotide is an L-deoxyribonucleotide. In some embodiments y=19 and (N')y in Structure A1 or N2-(N')y in Structure A2 consists of unmodified ribonucleotides at positions 1-17 and 19 and one L-DNA at the 3' penultimate position (position 18). In other embodiments y=19 and (N')y consists of unmodified ribonucleotides at position 1-16 and 19 and two consecutive L-DNA at the 3' penultimate position (positions 17 and 18). In some embodiments (N')y in Structure A1 or N2-(N')y in Structure A2 further include Z', for example C3OH and or z", for example and inverted abasic moiety or an amino moiety.

In another embodiment of the above structure, (N')y in Structure A1 or N2-(N')y in Structure A2 comprises at least two consecutive nucleotide joined together to the next nucleotide by a 2'-5' phosphodiester bond at one or both termini. In certain preferred embodiments in (N')y in Structure A1 or N2-(N')y in Structure A2 the 3' penultimate nucleotide is linked to the 3' terminal nucleotide with a 2'-5' phosphodiester bridge.

In certain preferred embodiments double stranded RNA molecule is a blunt-ended (i.e. z", Z and Z' are absent), double stranded oligonucleotide structure, x=y=19, wherein (N')y in Structure A1 or N2-(N')y in Structure A2 comprises unmodified ribonucleotides in which three consecutive nucleotides at the 3' terminus are joined together by two 2'-5' phosphodiester bonds; and an antisense strand (AS) of alternating unmodified and 2'-OMe sugar-modified ribonucleotides.

In one embodiment the double stranded nucleic acid molecule comprises an antisense strand and a sense strand selected from pairs of oligonucleotides set forth in SEQ ID NOS:13-5846 (targeting TLR2), SEQ ID NOS:5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP), or preferably oligonucleotide pairs set forth in Tables 1-5, infra, the antisense strand includes at least one 2'-OMe sugar modified pyrimidine ribonucleotide; a TNA, 2'-5' ribonucleotide a mirror nucleotide, a UNA or an abasic moiety in at least one of positions 1, 5, 6, or 7 (5'>3'); and a 3' terminal non-nucleotide moiety covalently attached to the 3' terminus; and the sense strand includes at least one 2'5' ribonucleotide or 2'-OMe modified ribonucleotide, and a non-nucleotide moiety covalently attached at the 3' terminus and a cap moiety covalently attached at the 5' terminus.

In one embodiment the double stranded nucleic acid molecule comprises an antisense strand and a sense strand selected from pairs of oligonucleotides in set forth in SEQ ID NOS:13-5846 (targeting TLR2), SEQ ID NOS:5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP), or preferably oligonucleotide pairs set forth in Tables 1-5, infra, the antisense strand includes at least one 2'-OMe sugar modified pyrimidine ribonucleotide, a TNA or 2'-5' ribonucleotide in position 7, and a nucleotide or non-nucleotide moiety covalently attached at the 3' terminus; and the sense strand includes 4-5 consecutive 2'5' ribonucleotides or TNA in the 3' terminal positions 16-19 or 15-19 (5'>3'), a non-nucleotide moiety covalently attached at the 3' terminus and a cap moiety such as an inverted abasic moiety covalently attached at the 5' terminus; and optionally includes a 2'-OMe sugar modified ribonucleotide at position 1 of the antisense strand or a 2'5' ribonucleotide at position 1 of the antisense strand.

In one embodiment the double stranded nucleic acid molecule comprises an antisense strand and a sense strand selected from pairs of oligonucleotides set forth in set forth in SEQ ID NOS:13-5846 (targeting TLR2), SEQ ID NOS:

5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP), or preferably oligonucleotide pairs set forth in Tables 1-5, infra, the antisense strand includes at least one 2'-OMe sugar modified pyrimidine ribonucleotide, a 2'-5' ribonucleotide in position 7, and a nucleotide or C3Pi-C3OH non-nucleotide moiety covalently attached at the 3' terminus; and the sense strand includes at least one 2'-OMe sugar modified pyrimidine ribonucleotide, a TNA or 2'5' ribonucleotide at position 9, a C3OH or C3Pi non-nucleotide moiety covalently attached at the 3' terminus and a cap moiety such as an inverted abasic moiety covalently attached at the 5' terminus.

In one embodiment the double stranded nucleic acid molecule comprises an antisense strand and a sense strand selected from pairs of oligonucleotides set forth in set forth in SEQ ID NOS:13-5846 (targeting TLR2), SEQ ID NOS: 5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP), or preferably oligonucleotide pairs set forth in Tables 1-5, infra, the sense strand includes at least one 2'-OMe sugar modified pyrimidine ribonucleotide; a nucleotide or non-nucleotide moiety covalently attached at the 3' terminus; and a cap moiety covalently attached at the 5' terminus; and the antisense strand includes at least one 2'-OMe sugar modified ribonucleotide; a TNA or 2'-5' ribonucleotide in at least one of positions 5, 6 or 7; and a nucleotide or non-nucleotide moiety covalently attached at the 3' terminus.

In one embodiment the double stranded nucleic acid molecule comprises an antisense strand and a sense strand selected from pairs of oligonucleotides set forth in set forth in SEQ ID NOS:13-5846 (targeting TLR2), SEQ ID NOS: 5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP), or preferably oligonucleotide pairs set forth in Tables 1-5, infra, the sense strand includes at least one 2'-OMe sugar modified pyrimidine ribonucleotide, a nucleotide or non-nucleotide moiety covalently attached at the 3' terminus, and a cap moiety covalently attached at the 5' terminus; and the antisense strand includes at least one 2'-OMe sugar modified ribonucleotide; a TNA or 2'-5' ribonucleotide at position 7; and a nucleotide or non-nucleotide moiety covalently attached at the 3' terminus.

In one embodiment the double stranded nucleic acid molecule comprises an antisense strand and a sense strand selected from pairs of oligonucleotides set forth in set forth in SEQ ID NOS:13-5846 (targeting TLR2), SEQ ID NOS: 5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP), or preferably oligonucleotide pairs set forth in Tables 1-5, infra, the sense strand includes at least one 2'-OMe sugar modified pyrimidine ribonucleotide; a C3OH moiety covalently attached at the 3' terminus; and a cap moiety such as an inverted abasic deoxyribonucleotide moiety covalently attached at the 5' terminus; and the antisense strand includes at least one 2'-OMe sugar modified pyrimidine ribonucleotide; a TNA or 2'-5' ribonucleotide at position 7 (5'>3'); and a nucleotide or C3Pi-C3OH non-nucleotide moiety covalently attached at the 3' terminus.

In one embodiment the double stranded nucleic acid molecule comprises an antisense strand and a sense strand selected from pairs of set forth in set forth in SEQ ID NOS:13-5846 (targeting TLR2), SEQ ID NOS:5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP), or preferably oligonucleotide pairs set forth in Tables 1-5, infra, the sense strand includes 2'-5' ribonucleotides in positions at the 3' terminus: a non-nucleotide moiety covalently attached at the 3' terminus and a cap moiety covalently attached at the 5' terminus; and the antisense strand includes at least one 2'-OMe sugar modified ribonucleotide; a TNA or 2'-5' ribonucleotide in at least one of positions 5, 6 or 7 (5'>3') and a nucleotide or non-nucleotide moiety covalently attached at the 3' terminus.

In one embodiment the double stranded nucleic acid molecule comprises an antisense strand and a sense strand selected from pairs of oligonucleotides set forth in set forth in SEQ ID NOS:13-5846 (targeting TLR2), SEQ ID NOS: 5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP), or preferably oligonucleotide pairs set forth in Tables 1-5, infra, the sense strand includes 4-5 consecutive TNA or 2'-5' ribonucleotides in positions (5'>3') 15-19 or 16-19, a C3-OH 3' moiety covalently attached at the 3' terminus and a cap moiety such as an inverted abasic deoxyribonucleotide moiety covalently attached at the 5' terminus; and the antisense strand includes at least one 2'-OMe sugar modified pyrimidine ribonucleotide; a TNA or 2'-5' ribonucleotide in position 7 and a nucleotide or C3Pi-C3OH moiety covalently attached at the 3' terminus.

In one embodiment the double stranded nucleic acid molecule comprises an antisense strand and a sense strand selected from pairs of oligonucleotides set forth in set forth in SEQ ID NOS:13-5846 (targeting TLR2), SEQ ID NOS: 5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP), or preferably oligonucleotide pairs set forth in Tables 1-5, infra, the sense strand includes at least one 2'-OMe sugar modified pyrimidine ribonucleotide, an optional 2'-5' ribonucleotide in one of position 9 or 10, a non-nucleotide moiety covalently attached at the 3' terminus and a cap moiety covalently attached at the 5' terminus; and the antisense strand includes at least one 2'-OMe sugar modified ribonucleotide, a TNA or 2'5' ribonucleotide in at least one of positions 5, 6, or 7; and a nucleotide or non-nucleotide moiety covalently attached at the 3' terminus.

In one embodiment the double stranded nucleic acid molecule comprises an antisense strand and a sense strand selected from pairs of set forth in set forth in SEQ ID NOS:13-5846 (targeting TLR2), SEQ ID NOS:5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP), or preferably oligonucleotide pairs set forth in Tables 1-5, infra, the sense strand includes at least one 2'-OMe sugar modified pyrimidine ribonucleotide, a 2'-5' ribonucleotide in position 9, a C3OH non-nucleotide moiety covalently attached at the 3' terminus and a cap moiety such as an inverted abasic deoxyribonucleotide moiety covalently attached at the 5' terminus; and the antisense strand includes at least one 2'-OMe sugar modified pyrimidine ribonucleotide, a TNA or 2'5' ribonucleotide in position 6; and a nucleotide or C3Pi-C3OH moiety covalently attached at the 3' terminus.

In one embodiment the double stranded nucleic acid molecule comprises an antisense strand and a sense strand selected from pairs of oligonucleotides set forth in set forth in SEQ ID NOS:13-5846 (targeting TLR2), SEQ ID NOS: 5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP), or preferably oligonucleotide pairs set forth in Tables 1-5, infra, the sense strand includes at least one 2'-OMe sugar modified pyrimidine ribonucleotide, a C3OH or C3Pi non-nucleotide moiety covalently attached at the 3' terminus and a cap moiety such as an inverted abasic deoxyribonucleotide moiety covalently attached at the 5' terminus; and the antisense strand includes at least one 2'-OMe sugar modified pyrimidine ribonucleotide, a 2'5' ribonucleotide in position 6; and a nucleotide or C3Pi-C3OH moiety covalently attached at the 3' terminus.

In some embodiments the nucleotide moiety covalently attached at the 3' terminus comprises the dinucleotide dTdT.

According to one aspect, the present invention provides a method of generating a double stranded RNA molecule consisting of a sense strand and an antisense strand having oligonucleotide sequences forth in SEQ ID NOS:13-3060 to target TLR2; SEQ ID NOS:5847-8612 to target TLR4; SEQ ID NOS:12145-13924 to target MYD88; SEQ ID NOS: 16333-16882 to target TICAM1; or SEQ ID NOS:18243-19046 to target TIRAP, the method comprising the steps
a) synthesizing a sense strand;
b) synthesizing an antisense strand;
c) annealing the sense strand to the antisense strand;
thereby generating a double stranded RNA molecule. In some embodiment the synthesis includes synthesis of a chemically unmodified dsRNA strand. In some embodiments synthesis includes incorporation of modified nucleotides including 2'-OMe sugar modified ribonucleotides or unconventional moieties including 2'5' linked nucleic acid, abasic and inverted abasic moieties and the like.

In some embodiments, neither (N)x nor (N')y are phosphorylated at the 3' and 5' termini. In other embodiments either or both (N)x and (N')y are phosphorylated at the 3' termini.

In a second aspect, provided herein are pharmaceutical compositions comprising one or more double stranded molecules as disclosed herein, in an amount effective to inhibit target gene expression, and a pharmaceutically acceptable carrier wherein the target gene is selected from a gene having a mRNA set forth in SEQ ID NOS:1-12.

In another aspect provided is a cell comprising one or more double stranded molecule as disclosed herein in an amount effective to inhibit target gene expression.

In various embodiments the compound comprises an antisense oligonucleotide (N)x and a corresponding sense oligonucleotide, the oligonucleotide pairs set forth in SEQ ID NOS:13-5846 (targeting TLR2), SEQ ID NOS:5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP), or preferably oligonucleotide pairs set forth in Tables 1-5, infra.

In other aspects disclosed are oligonucleotide compounds useful in preventing or treating chronic or acute aseptic inflammation, neuropathic pain, primary graft failure, ischemia-reperfusion injury, reperfusion injury, reperfusion edema, allograft dysfunction, pulmonary reimplantation response and/or primary graft dysfunction (PGD) in organ transplantation, such as lung transplantation in a subject in need thereof.

In another aspect, provided is a method for the treatment of a subject in need of treatment for a disease or disorder or symptom or condition associated with the disease or disorder, associated with the expression of a target gene comprising administering to the subject an amount of a double stranded molecule as disclosed herein which reduces or inhibits expression of a target gene. In preferred embodiments the double stranded molecule is chemically modified as described herein.

Also provided is a double stranded molecule as described herein for the treatment of a disease or injury selected from chronic or acute aseptic inflammation, neuropathic pain, primary graft failure, ischemia-reperfusion injury, reperfusion injury, reperfusion edema, allograft dysfunction, pulmonary reimplantation response and/or primary graft dysfunction (PGD) in organ transplantation, such as lung transplantation.

Further provided is a double stranded molecule as described herein for the preparation of a medicament for the treatment of a disease or injury selected from chronic or acute aseptic inflammation, neuropathic pain, primary graft failure, ischemia-reperfusion injury, reperfusion injury, reperfusion edema, allograft dysfunction, pulmonary reimplantation response and/or primary graft dysfunction (PGD) in organ transplantation, such as lung transplantation.

In other aspects the disclosure relates to methods for treating or preventing the incidence or severity of a post-transplantational (e.g. following lung transplantation) complication selected from, without being limited to, primary graft failure, ischemia-reperfusion injury, reperfusion injury, reperfusion edema, allograft dysfunction, pulmonary reimplantation response and/or primary graft dysfunction (PGD), in a subject in need thereof wherein the complication is associated with expression of a gene selected from a gene set forth in Table A1. Such methods involve administering to a mammal in need of such treatment a prophylactically or therapeutically effective amount of one or more double stranded molecules disclosed herein to inhibit or reduce expression or activity of at least one such gene. In other aspects the disclosure relates to methods for reducing acute or chronic inflammation in a subject in need thereof wherein the inflammation is associated with expression of a gene selected from a gene set forth in Table A1. Such methods involve administering to a mammal in need of such treatment a prophylactically or therapeutically effective amount of one or more double stranded molecules disclosed herein to inhibit or reduce expression or activity of at least one such gene.

In some embodiments posttransplantational complication is present in an organ transplant recipient (such as a lung transplantation recipient) and the target gene is selected from TLR2, TLR4, MYD88, TICAM1 and TIRAP, having mRNA polynucleotide sequences set forth in SEQ ID NOS: 1-12. Sense and antisense oligonucleotide pairs useful in preparing dsRNA for inhibiting expression of TLR2, TLR4, MYD88, TICAM1 and TIRAP are set forth in SEQ ID NOS:13-5846 (targeting TLR2), SEQ ID NOS:5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP) or preferably oligonucleotide pairs set forth in Tables 1-5, infra.

The methods, materials, and examples that will now be described are illustrative only and are not intended to be limiting; materials and methods similar or equivalent to those described herein can be used in practice or testing of the invention. Other features and advantages of the invention will be apparent from the following detailed description, and from the claims.

This disclosure is intended to cover any and all adaptations or variations of combination of features that are disclosed in the various embodiments herein. Although specific embodiments have been illustrated and described herein, it should be appreciated that the invention encompasses any arrangement of the features of these embodiments to achieve the same purpose. Combinations of the above features, to form embodiments not specifically described herein, will be apparent to those of skill in the art upon reviewing the instant description.

DETAILED DESCRIPTION OF THE INVENTION

The present invention relates in general to compounds which down-regulate expression of certain target genes associated with posttransplantational (e.g. following lung transplantation) complications and their use in treating a subject suffering from diseases or disorders associated with such posttransplantational complications. Inhibition of expression of the one or more of the target genes selected from TLR2, TLR4, MYD88, TICAM1 and TIRAP is now shown to be beneficial in treating a subject suffering from an adverse effect of organ transplantation, for example lung transplantation; more specifically from a posttransplantational (e.g. following lung transplantation) complication selected from, without being limited to, primary graft failure, ischemia-reperfusion injury, reperfusion injury, reperfusion edema, allograft dysfunction, pulmonary reimplantation response and/or primary graft dysfunction (PGD). The present invention relates in particular to small double stranded RNA compounds, such as interfering RNA (siRNA) compounds which inhibit expression of TLR2, TLR4, MYD88, TICAM1 and TIRAP, and to the use of these siRNA compounds in the treatment of certain diseases and disorders. Preferred sense and antisense oligonucleotides useful in the preparation of dsRNA compounds are set forth in SEQ ID NOS:13-5846 (targeting TLR2), SEQ ID NOS:5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP).

Compounds, compositions and methods for inhibiting target genes having mRNA set forth in any one of SEQ ID NOS:1-12 are discussed herein at length, and any of said compounds and/or compositions are beneficially employed in the treatment of a patient suffering from posttransplantational (e.g. following lung transplantation) complications encountered following transplantation.

Provided herein are compositions and methods for inhibiting expression of a target gene selected from TLR2, TLR4, MYD88, TICAM1 and TIRAP genes in vivo. In general, the method includes administering oligoribonucleotides, such as dsRNA compounds, including small interfering RNAs (i.e., siRNAs) that target mRNA selected from SEQ ID NOS:1 (TLR2 mRNA); SEQ ID NO:2-4 (TLR4 mRNA), SEQ ID NO:5-9 (MYD88 mRNA), SEQ ID NO:10 (TICAM1 mRNA) or SEQ ID NO:11-12 (TIRAP mRNA).

Methods for the delivery of chemically modified dsRNA compounds to a subject are discussed herein at length, and said molecules and/or compositions may be beneficially employed in the treatment of a subject suffering from the diseases and disorders disclosed herein. Treatment may be full or partial and is readily determined by one with skill in the art.

The compounds disclosed herein possess structures and modifications which increase activity, increase stability, minimize toxicity, reduce off target effects and/or reduce immune response when compared to an unmodified dsRNA compound; the novel modifications of the dsRNAs disclosed herein are beneficially applied to double stranded oligonucleotide sequences useful in preventing or attenuating target gene expression, in particular the target genes discussed herein.

Details of the target genes disclosed herein are presented in Table A1, hereinbelow.

TABLE A1

| Target genes | |
|---|---|
| Target gene | SEQ NO, Full name and gi and accession numbers |
| TLR2 | SEQ ID NO: 1 >gi|68160956|ref|NM_003264.3|*Homo sapiens* Toll-like receptor 2 (TLR2), mRNA |
| TLR4 | SEQ ID NO: 2 >gi|207028620|ref|NM_138554.3|*Homo sapiens* toll-like receptor 4 (TLR4), transcript variant 1, mRNA |
| | SEQ ID NO: 3 >gi|207028451|ref|NR_024168.1|*Homo sapiens* toll-like receptor 4 (TLR4), transcript variant 3, non-coding RNA |
| | SEQ ID NO: 4 >gi|207028550|ref|NR_024169.1|*Homo sapiens* toll-like receptor 4 (TLR4), transcript variant 4, non-coding RNA |
| MYD88 | SEQ ID NO: 5 >gi|197276653|ref|NM_002468.4|*Homo sapiens* myeloid differentiation primary response gene (88) (MYD88), mRNA |
| | SEQ ID NO: 6 >gi|289546502|ref|NM_001172567.1|*Homo sapiens* myeloid differentiation primary response gene (88) (MYD88), transcript variant 1, mRNA |
| | SEQ ID NO: 7 >gi|289546580|ref|NM_001172568.1|*Homo sapiens* myeloid differentiation primary response gene (88) (MYD88), transcript variant 3, mRNA |
| | SEQ ID NO: 8 >gi|289546652|ref|NM_001172569.1|*Homo sapiens* myeloid differentiation primary response gene (88) (MYD88), transcript variant 4, mRNA |
| | SEQ ID NO: 9 >gi|289546499|ref|NM_001172566.1|*Homo sapiens* myeloid differentiation primary response gene (88) (MYD88), transcript variant 5, mRNA |
| TICAM1 | SEQ ID NO: 10 >gi|197209874|ref|NM_182919.2|*Homo sapiens* toll-like receptor adaptor molecule 1 (TICAM1, TRIF), mRNA |

TABLE A1-continued

Target genes

| Target gene | SEQ NO, Full name and gi and accession numbers |
|---|---|
| TIRAP | SEQ ID NO: 11 >gi|89111123|ref|NM_148910.2|*Homo sapiens* toll-interleukin 1 receptor (TIR) domain containing adaptor protein (TIRAP), transcript variant 2, mRNA<br>SEQ ID NO: 12 >gi|89111121|ref|NM_001039661.1|*Homo sapiens* toll-interleukin 1 receptor (TIR) domain containing adaptor protein (TIRAP), transcript variant 3, mRNA |

Table A1 provides the gi (GeneInfo identifier) and accession numbers for exemplary polynucleotide sequences of human mRNA to which the oligonucleotide inhibitors as disclosed herein are directed.

Inhibition of any one of the mRNA polynucleotides set forth in Table A1 is useful in preventing, treating and/or attenuating acute or chronic inflammation, neuropathic pain, posttransplantational complication in organ transplant, (for example lung transplant) patients, such as for example primary graft failure, ischemia-reperfusion injury, reperfusion injury, reperfusion edema, allograft dysfunction, pulmonary reimplantation response and/or primary graft dysfunction (PGD).

In various embodiments, disclosed are chemically modified dsRNA molecules, including small interfering RNAs (siRNAs), and the use of the dsRNAs in the prevention and treatment of various posttransplantational complications in organ transplant, for example lung transplant, patients. Diseases and conditions to be treated are directed to chronic or acute aseptic inflammation, neuropathic pain, primary graft failure, ischemia-reperfusion injury, reperfusion injury, reperfusion edema, allograft dysfunction, pulmonary reimplantation response and/or primary graft dysfunction (PGD).

Lists of preferred sense and antisense oligonucleotides useful in synthesizing dsRNA compounds are provided in SEQ ID NOS:13-5846 (targeting TLR2), SEQ ID NOS: 5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP). The 18- and 19-mer sense oligonucleotides and corresponding antisense oligonucleotides useful in the synthesis of dsRNA compounds are prioritized based on their score according to a proprietary algorithm as the best sequences for targeting the human gene expression. Molecules, compositions and methods, which inhibit target genes are discussed herein at length, and any of said molecules and/or compositions are beneficially employed in the treatment of a patient suffering from any of said posttransplantational complications.

Structural Design

In one aspect, provided herein are double stranded nucleic acid molecules comprising a sense strand and an antisense strand, wherein at least one strand comprises 1, 2, 3, 4, or 5 non-nucleotide moieties covalently attached at the 3' terminal end; wherein the non-nucleotide moiety is selected from an alkyl (hydrocarbon) moiety or a derivative thereof and a phosphate based moiety. In certain preferred embodiment the non-nucleotide moiety includes an alkyl moiety or an alkyl derivative moiety. In some embodiments the at least one strand is the antisense stand. In preferred embodiments the antisense strand comprises two non-nucleotide moieties covalently attached at the 3' terminal end, including C3-C3; C3-C3-Pi; C3-C3-Ps; idAb-idAb moieties as defined hereinbelow.

In various embodiments provided herein is a double stranded nucleic acid molecule, wherein:

(a) the nucleic acid molecule includes a sense strand and an antisense strand;

(b) each strand of the nucleic acid molecule is independently 17 to 40 nucleotides in length;

(c) a 17 to 40 nucleotide sequence of the antisense strand is complementary to a sequence of a mRNA selected from a mRNA encoding TLR2 (e.g., SEQ ID NO: 1), a mRNA encoding TLR4 (e.g., SEQ ID NOs: 2-4); a mRNA encoding MYD88 (e.g. SEQ ID NO:5-9; a mRNA encoding TICAM1 (e.g. SEQ ID NO:10) or a mRNA encoding TIRAP (e.g. SEQ ID NO:11-12);

and (d) a 17 to 40 nucleotide sequence of the sense strand is complementary to the antisense strand and includes a 17 to 40 nucleotide sequence of a mRNA selected from a mRNA encoding TLR2 (e.g., SEQ ID NO: 1), a mRNA encoding TLR4 (e.g., SEQ ID NOs: 2-4); a mRNA encoding MYD88 (e.g. SEQ ID NO:5-9; a mRNA encoding TICAM1 (e.g. SEQ ID NO:10) or a mRNA encoding TIRAP (e.g. SEQ ID NO:11-12)

In some embodiments, provided are double stranded nucleic acid molecules having the structure (A1):

(A1)　　5' (N)x-Z 3'　　(antisense strand)

3' Z'-(N')y-z" 5'　　(sense strand)

wherein each of N and N' is a nucleotide which may be unmodified or modified, or an unconventional moiety;

wherein each of (N)x and (N')y is an oligonucleotide in which each consecutive N or N' is joined to the next N or N' by a covalent bond;

wherein at least one of Z or Z' is present and comprises a non-nucleotide moiety covalently attached at the 3' terminus of the strand in which it is present;

wherein z" may be present or absent, but if present is a capping moiety covalently attached at the 5' terminus of (N')y;

wherein each of x and y is independently an integer between 18 and 40;

wherein the sequence of (N')y has complementarity to the sequence of (N)x; and wherein the sequence of (N)x has complementarity to a consecutive sequence in a target RNA set forth in any one of SEQ ID NOS:1-12.

In some embodiments the covalent bond joining each consecutive N or N' is a phosphodiester bond.

In some embodiments x=y=18 to 25 or 19 to 27, for example 18, 19, 20, 21, 22, 23, 24, 25, 26, 27. In some embodiments x=y and each of x and y is 19, 20, 21, 22 or 23. In various embodiments x=y=19.

In some embodiments x=y=19 and one of Z or Z' is present and consists of two non-nucleotide moieties.

In some embodiments x=y=19 and Z' is present and consists of two non-nucleotide moieties.

In preferred embodiments x=y=19 and Z is present and consists two non-nucleotide moieties.

In preferred embodiments x=y=19 and Z is present and consists of two non-nucleotide moieties; and Z' is present and consists of one non-nucleotide moiety.

In additional embodiments x=y=19 and Z and Z' are present and each independently comprises two non-nucleotide moieties.

In some embodiments the double stranded nucleic acid molecules comprise a DNA moiety or a mismatch to the target at position 1 of the antisense strand (5' terminus). Such a structure is described herein. According to one embodiment provided are double stranded nucleic acid molecules having a structure (A2) set forth below:

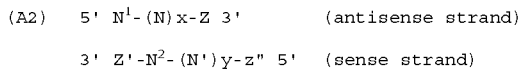

```
(A2)   5' N¹-(N)x-Z 3'         (antisense strand)
       3' Z'-N²-(N')y-z" 5'    (sense strand)
``` wherein each of $N^2$, N and N' is an unmodified or modified ribonucleotide, or an unconventional moiety;
wherein each of (N)x and (N')y is an oligonucleotide in which each consecutive N or N' is joined to the adjacent N or N' by a covalent bond;
wherein each of x and y is independently an integer between 17 and 39;
wherein the sequence of (N')y has complementarity to the sequence of (N)x and (N)x has complementarity to a consecutive sequence in a target RNA set forth in SEQ ID NOS:1-12;
wherein $N^1$ is covalently bound to (N)x and is mismatched to the target RNA or is a complementary DNA moiety to the target RNA;
wherein $N^1$ is a moiety selected from the group consisting of natural or modified uridine, deoxyribouridine, ribothymidine, deoxyribothymidine, adenosine or deoxyadenosine;
wherein z" may be present or absent, but if present is a capping moiety covalently attached at the 5' terminus of $N^2$—(N')y; and
wherein at least one of Z or Z' is present and comprises a non-nucleotide moiety covalently attached at the 3' terminus of the strand in which it is present.

In some embodiments x=y=17 to 24 or 18 to 23. In preferred embodiments x=y=18.

In some embodiments x=y=18 and Z' is present and consists of two non-nucleotide moieties.

In preferred embodiments x=y=18 and Z is present and consists two non-nucleotide moieties.

In preferred embodiments x=y=18 and Z is present and consists of two non-nucleotide moieties; and Z' is present and consists of one non-nucleotide moiety.

In additional embodiments x=y=18 and Z and Z' are present and each independently comprises two non-nucleotide moieties.

In some embodiments the sequence of (N')y is fully complementary to the sequence of (N)x. In various embodiments sequence of $N^2$-(N')y is complementary to the sequence of $N^1$-(N)x. In some embodiments (N)x comprises an antisense that is fully complementary to about 17 to about 39 consecutive nucleotides in a target RNA. In other embodiments (N)x comprises an antisense that is substantially complementary to about 17 to about 39 consecutive nucleotides in a target RNA.

In some embodiments $N^1$ and $N^2$ form a Watson-Crick base pair. In some embodiments $N^1$ and $N^2$ form a non-Watson-Crick base pair. In some embodiments a base pair is formed between a ribonucleotide and a deoxyribonucleotide.

In some embodiments x=y=18, x=y=19 or x=y=20. In preferred embodiments x=y=18. When x=18 in $N^1$-(N)x, $N^1$ refers to position 1 and positions 2-19 are included in $(N)_{18}$. When y=18 in $N^2$-(N')y, $N^2$ refers to position 19 and positions 1-18 are included in $(N)_{18}$.

In some embodiments $N^1$ is covalently bound to (N)x and is mismatched to the target RNA. In various embodiments $N^1$ is covalently bound to (N)x and is a DNA moiety complementary to the target RNA.

In some embodiments a uridine in position 1 of the antisense strand is substituted with an $N^1$ selected from adenosine, deoxyadenosine, deoxyuridine (dU), ribothymidine or deoxythymidine. In various embodiments $N^1$ selected from adenosine, deoxyadenosine or deoxyuridine.

In some embodiments guanosine in position 1 of the antisense strand is substituted with an $N^1$ selected from adenosine, deoxyadenosine, uridine, deoxyuridine, ribothymidine or deoxythymidine. In various embodiments $N^1$ is selected from adenosine, deoxyadenosine, uridine or deoxyuridine.

In some embodiments cytidine in position 1 of the antisense strand is substituted with an $N^1$ selected from adenosine, deoxyadenosine, uridine, deoxyuridine, ribothymidine or deoxythymidine. In various embodiments $N^1$ is selected from adenosine, deoxyadenosine, uridine or deoxyuridine.

In some embodiments adenosine in position 1 of the antisense strand is substituted with an $N^1$ selected from deoxyadenosine, deoxyuridine, ribothymidine or deoxythymidine. In various embodiments $N^1$ selected from deoxyadenosine or deoxyuridine.

In some embodiments $N^1$ and $N^2$ form a base pair between uridine or deoxyuridine, and adenosine or deoxyadenosine. In other embodiments $N^1$ and $N^2$ form a base pair between deoxyuridine and adenosine.

In some embodiments the double stranded nucleic acid molecule is a double stranded RNA, such as an siRNA, siNA or a miRNA. The double stranded nucleic acid molecules as provided herein are also referred to as "duplexes".

In certain preferred embodiments x=y=18. In some embodiments $N^1$ and $N^2$ form a Watson-Crick base pair. In other embodiments $N^1$ and $N^2$ form a non-Watson-Crick base pair. In certain embodiments $N^1$ is selected from the group consisting of riboadenosine, modified riboadenosine, deoxyriboadenosine, modified deoxyriboadenosine. In other embodiments $N^1$ is selected from the group consisting of ribouridine, deoxyribouridine, modified ribouridine, and modified deoxyribouridine.

In certain embodiments position 1 in the antisense strand (5' terminus) comprises deoxyribouridine (dU) or adenosine. In some embodiments $N^1$ is selected from the group consisting of riboadenosine, modified riboadenosine, deoxyriboadenosine, modified deoxyriboadenosine and $N^2$ is selected from the group consisting of ribouridine, deoxyribouridine, modified ribouridine, and modified deoxyribouridine. In certain embodiments $N^1$ is selected from the group consisting of riboadenosine and modified riboadenosine and $N^2$ is selected from the group consisting of ribouridine and modified ribouridine.

In certain embodiments $N^1$ is selected from the group consisting of ribouridine, deoxyribouridine, modified ribouridine, and modified deoxyribouridine and $N^2$ is selected from the group consisting of riboadenosine, modified riboadenosine, deoxyriboadenosine, modified deoxyriboadenosine. In certain embodiments $N^1$ is selected from the group consisting of ribouridine and deoxyribouridine and $N^2$ is selected from the group consisting of riboadenosine and modified riboadenosine. In certain embodiments $N^1$ is oriburidine and $N^2$ is riboadenosine. In certain embodiments $N^1$ is deoxyribouridine and $N^2$ is riboadenosine.

In some embodiments of Structure (A2), $N^1$ includes 2'-OMe sugar-modified ribouracil or 2'-OMe sugar-modified riboadenosine. $N^1$ includes 2' fluoro and 2' amino sugar-modified ribouracil or 2' fluoro and 2' amino sugar-modified riboadenosine. In certain embodiments of structure (A2), $N^2$ includes a 2'-OMe sugar modified ribonucleotide or deoxyribonucleotide.

In some embodiments of Structure (A2), $N^1$ includes 2'-OMe sugar-modified ribouracil or 2'-OMe sugar-modified ribocytosine. In certain embodiments of structure (A2), $N^2$ includes a 2'-OMe sugar modified ribonucleotide.

The following table, Table A2 provides non-limiting examples of $N^1$ and corresponding $N^2$.

| Target nucleotide | 5' terminal nucleotide of AS with full match to target | $N^1$ (5' terminal position of AS) | $N^2$ (3' terminal position of SEN) |
|---|---|---|---|
| A | U | rA, dA | rU, dU, rT, dT |
| A | U | dU, rT, dT | rA, dA |
| C | G | rA, dA | rU, dU, rT, dT |
| C | G | rU, dU, rT, dT | rA, dA |
| G | C | rA, dA | rU, dU, rT, dT |
| G | C | rU, dU, rT, dT | rA, dA |
| U | A | dA | rU, dU rT, dT |
| U | A | dU rT, dT | rA, dA |

In some embodiments each of N and N' is an unmodified nucleotide. In some embodiments at least one of N or N' includes a chemically modified nucleotide or an unconventional moiety. In some embodiments the unconventional moiety is selected from a mirror nucleotide, an abasic ribose moiety and an abasic deoxyribose moiety. In some embodiments the unconventional moiety is a mirror nucleotide, preferably an L-DNA moiety. In some embodiments at least one of N or N' includes a 2'-OMe sugar-modified ribonucleotide.

In some embodiments the sequence of (N')y is fully complementary to the sequence of (N)x. In other embodiments the sequence of (N')y is substantially complementary to the sequence of (N)x.

In some embodiments (N)x includes an antisense sequence that is fully complementary to about 17 to about 39 consecutive nucleotides in a target RNA. In other embodiments (N)x includes an antisense that is substantially complementary to about 17 to about 39 consecutive nucleotides in a target RNA.

In some embodiments the nucleic acid molecules disclosed herein are dsRNA molecules, such as siRNA, siNA or miRNA.

In some embodiments of Structures A1 and A2, Z is present and Z' is absent. In other embodiments Z' is present and Z is absent. In additional embodiments both Z and Z' are present. In some embodiments Z and Z' are present and are identical. In further embodiments Z and Z' are present and are different. In some embodiments Z and Z' are independently 2, 3, 4 or 5 non-nucleotide moieties or a combination of 2, 3, 4, or 5 non-nucleotide moieties and nucleotides. In some embodiments each of Z and or Z' consist of two (2) non-nucleotide moieties covalently attached to the 3' terminus of the dsRNA strand via a phosphodiester bond.

A non-nucleotide moiety is selected from the group consisting of an abasic moiety, an inverted abasic moiety, an alkyl moiety or derivative thereof, and an inorganic phosphate. In some embodiments a non-nucleotide moiety is an alkyl moiety or derivative thereof. In some embodiments the alkyl moiety comprises a terminal functional group selected from the group consisting of an alcohol, a terminal amine, a terminal phosphate and a terminal phosphorothioate moiety.

In some embodiments Z is present and comprises one or more non-nucleotide moieties selected from the group consisting of an abasic moiety, an inverted abasic moiety, hydrocarbon moiety or derivative thereof, and an inorganic phosphate. In some embodiments Z is present and consists of two alkyl moieties or derivatives thereof.

In additional embodiments Z' is present and comprises one or more non-nucleotide moieties selected from the group consisting of an abasic moiety, an inverted abasic moiety, a hydrocarbon moiety, and an inorganic phosphate. In some embodiments Z' is present and comprises one or more alkyl moieties or derivatives thereof.

In some embodiments Z is present and consists of two alkyl moieties or derivatives thereof and Z' is present and consists of a single alkyl moiety or derivative thereof.

In some embodiments each of Z and Z' includes an abasic moiety, for example a deoxyriboabasic moiety (referred to herein as "dAb") or riboabasic moiety (referred to herein as "rAb"). In some embodiments each of Z and/or Z' comprises two covalently linked abasic moieties and is for example 5'>3' dAb-dAb or rAb-rAb or dAb-rAb or rAb-dAb. Each moiety is covalently conjugated to an adjacent moiety via a covalent bond, preferably a phospho-based bond. In some embodiments the phospho-based bond is a phosphorothioate, a phosphonoacetate or a phosphodiester bond.

In some embodiments each of Z and/or Z' independently includes a C2, C3, C4, C5 or C6 alkyl moiety, optionally a C3 [propane, —(CH2)$_3$-] moiety or a derivative thereof e.g. propanol (C3-OH), propanediol, or phosphodiester derivative of propanediol ("C3Pi"). In preferred embodiments each of Z and/or Z' includes two hydrocarbon moieties and in some examples is C3-C3. Each C3 is covalently conjugated to an adjacent C3 via a covalent bond, preferably a phospho-based bond. In some embodiments the phospho-based bond is a phosphorothioate, a phosphonoacetate or a phosphodiester bond.

In some embodiments each of Z and Z' is independently selected from propanol, propyl phosphate, propyl phosphorothioate, combinations thereof or multiples thereof.

Non-limiting exemplary non-nucleotide moieties are set forth in the diagram below:

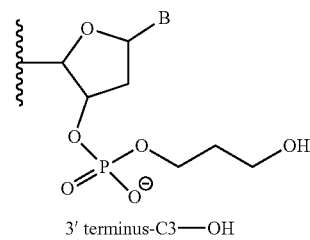

3' terminus-C3—OH

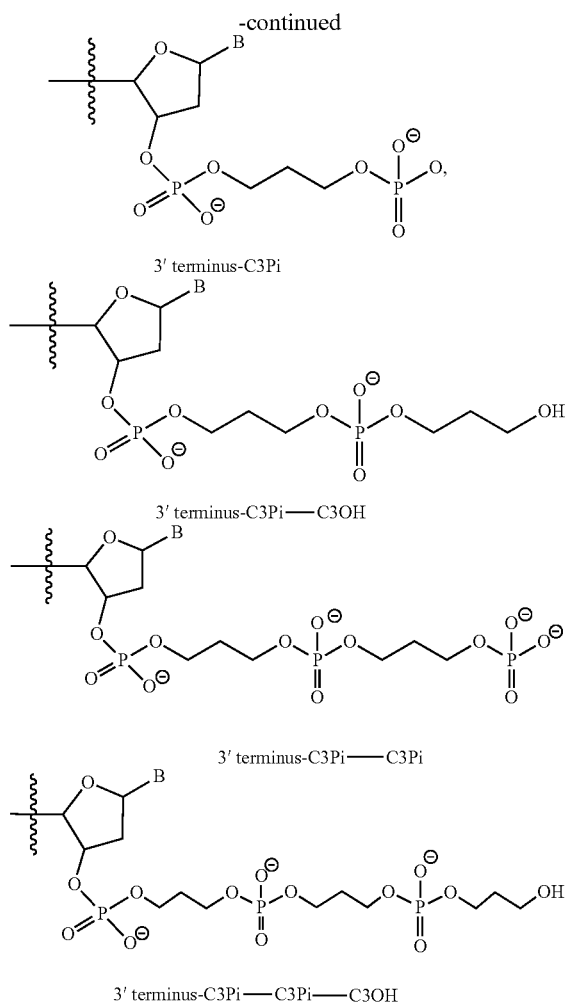

3' terminus-C3Pi

3' terminus-C3Pi——C3OH

3' terminus-C3Pi——C3Pi

3' terminus-C3Pi——C3Pi——C3OH

In some embodiments of Structure A1 and Structure A2 at least one of Z or Z' is present and comprises at least two non-nucleotide moieties covalently attached to the strand in which it is present. In some embodiments each of Z and Z' independently includes a C3 alkyl, C3 alcohol or C3 ester moiety. In some embodiments Z' is absent and Z is present and includes a non-nucleotide C3 moiety. In some embodiments Z is absent and Z' is present and includes a non-nucleotide C3 moiety.

In some embodiments of Structures A1 and A2, each of N and N' is an unmodified nucleotide. In some embodiments at least one of N or N' includes a chemically modified nucleotide or an unconventional moiety. In some embodiments the unconventional moiety is selected from a mirror nucleotide, an abasic ribose moiety and an abasic deoxyribose moiety. In some embodiments the unconventional moiety is a mirror nucleotide, preferably an L-DNA moiety. In some embodiments at least one of N or N' includes a 2'-OMe sugar-modified ribonucleotide.

In some embodiments the sequence of (N')y is fully complementary to the sequence of (N)x. In other embodiments the sequence of (N')y is substantially complementary to the sequence of (N)x.

In other embodiments the compound of Structure A1 or Structure A2 includes at least one ribonucleotide modified in the sugar residue. In some embodiments the compound includes a modification at the 2' position of the sugar residue. In some embodiments the modification in the 2' position includes the presence of an amino, a fluoro, an alkoxy or an alkyl moiety. In certain embodiments the 2' modification includes an alkoxy moiety, In preferred embodiments the alkoxy moiety is a methoxy moiety (also known as 2'-O-methyl; 2'-OMe; 2'-OCH3). In some embodiments the nucleic acid compound includes 2'-OMe sugar modified alternating ribonucleotides in one or both of the antisense and the sense strands. In other embodiments the compound includes 2'-OMe sugar modified ribonucleotides in the antisense strand, (N)x or $N^1$-(N)x, only. In certain embodiments the middle ribonucleotide of the antisense strand; e.g. ribonucleotide in position 10 in a 19-mer strand is unmodified. In various embodiments the nucleic acid compound includes at least 5 alternating 2'-OMe sugar modified and unmodified ribonucleotides. In additional embodiments the compound of Structure A1 or Structure A2 includes modified ribonucleotides in alternating positions wherein each ribonucleotide at the 5' and 3' termini of (N)x or $N^1$-(N)x are in their sugar residues, and each ribonucleotide at the 5' and 3' termini of (N')y or $N^2$-(N)y are unmodified in their sugar residues.

In some embodiments the double stranded molecule includes one or more of the following modifications
a) N in at least one of positions 5, 6, 7, 8, or 9 from the 5' terminus of the antisense strand is selected from a 2'5' nucleotide or a mirror nucleotide;
b) N' in at least one of positions 9 or 10 from the 5' terminus of the sense strand is selected from a 2'5' nucleotide and a pseudoUridine; and
c) N' in 4, 5, or 6 consecutive positions at the 3' terminus positions of (N')y comprises a 2'5' nucleotide.

In some embodiments the double stranded molecule includes a combination of the following modifications
a) the antisense strand includes a 2'5' nucleotide or a mirror nucleotide in at least one of positions 5, 6, 7, 8, or 9 from the 5' terminus; and
b) the sense strand includes at least one of a 2'5' nucleotide and a pseudoUridine in positions 9 or 10 from the 5' terminus.

In some embodiments the double stranded molecule includes a combination of the following modifications
a) the antisense strand includes a 2'5' nucleotide or a mirror nucleotide in at least one of positions 5, 6, 7, 8, or 9 from the 5' terminus; and
c) the sense strand includes 4, 5, or 6 consecutive 2'5' nucleotides at the 3' penultimate or 3' terminal positions.

In some embodiments, the sense strand [(N)x or $N^1$-(N)x] includes 1, 2, 3, 4, 5, 6, 7, 8, or 9 2'-OMe sugar modified ribonucleotides. In some embodiments, the antisense strand includes 2'-OMe modified ribonucleotides at positions 2, 4, 6, 8, 11, 13, 15, 17 and 19. In other embodiments antisense strand includes 2'-OMe modified ribonucleotides at positions 1, 3, 5, 7, 9, 11, 13, 15, 17 and 19. In other embodiments the antisense strand includes 2'-OMe modified ribonucleotides at positions 3, 5, 7, 9, 11, 13, 15, 17 and 19. In some embodiments the antisense strand includes one or more 2'-OMe sugar modified pyrimidines. In some embodiments all the pyrimidine nucleotides in the antisense strand are 2'-OMe sugar modified. In some embodiments the sense strand includes 2'-OMe sugar modified pyrimidines.

In some embodiments of Structure A1 and Structure A2, the sense strand and the antisense strand are independently phosphorylated or unphosphorylated at the 3' terminus and at the 5' terminus. In some embodiments of Structure A1 and Structure A2, the sense strand and the antisense strand are unphosphorylated at the 3' and 5' termini. In other embodiments the sense strand and the antisense strand are phosphorylated at the 3' termini.

In some embodiments of Structure A1 and Structure A2 (N)y includes at least one unconventional moiety selected from a mirror nucleotide, a 2'5' nucleotide and a TNA. In some embodiments the unconventional moiety is a mirror nucleotide. In various embodiments the mirror nucleotide is selected from an L-ribonucleotide (L-RNA) and an L-deoxyribonucleotide (L-DNA). In preferred embodiments the mirror nucleotide is L-DNA. In certain embodiments the sense strand comprises an unconventional moiety in position 9 or 10 (from the 5' terminus). In preferred embodiments the sense strand includes an unconventional moiety in position 9 (from the 5' terminus). In some embodiments the sense strand is 19 nucleotides in length and comprises 4, 5, or 6 consecutive unconventional moieties in positions 15, (from the 5' terminus). In some embodiments the sense strand includes 4 consecutive 2'5' ribonucleotides in positions 15, 16, 17, and 18. In some embodiments the sense strand includes 5 consecutive 2'5' ribonucleotides in positions 15, 16, 17, 18 and 19. In various embodiments the sense strand further comprises Z'. In some embodiments Z' includes a C3OH moiety or a C3Pi moiety.

In some embodiments of Structure A1 (N')y includes at least one L-DNA moiety. In some embodiments x=y=19 and (N')y, consists of unmodified ribonucleotides at positions 1-17 and 19 and one L-DNA at the 3' penultimate position (position 18). In other embodiments x=y=19 and (N')y consists of unmodified ribonucleotides at positions 1-16 and 19 and two consecutive L-DNA at the 3' penultimate position (positions 17 and 18). In various embodiments the unconventional moiety is a nucleotide joined to an adjacent nucleotide by a 2'-5' internucleotide phosphate linkage. According to various embodiments (N')y includes 2, 3, 4, 5, or 6 consecutive ribonucleotides at the 3' terminus linked by 2'-5' internucleotide linkages. In one embodiment, four consecutive nucleotides at the 3' terminus of (N')y are joined by three 2'-5' phosphodiester bonds, wherein one or more of the 2'-5' nucleotides which form the 2'-5' phosphodiester bonds further includes a 3'-O-methyl (3'OMe) sugar modification. Preferably the 3' terminal nucleotide of (N')y includes a 2'-OMe sugar modification. In certain embodiments x=y=19 and (N')y includes two or more consecutive nucleotides at positions 15, 16, 17, 18 and 19 include a nucleotide joined to an adjacent nucleotide by a 2'-5' internucleotide bond (2'-5' nucleotide). In various embodiments the nucleotide forming the 2'-5' internucleotide bond includes a 3' deoxyribose nucleotide or a 3' methoxy nucleotide (3' H or 3'OMe in place of a 3' OH). In some embodiments x=y=19 and (N')y includes 2'-5' nucleotides at positions 15, 16 and 17 such that adjacent nucleotides are linked by a 2'-5' internucleotide bond between positions 15-16, 16-17 and 17-18; or at positions, 15, 16, 17, 18, and 19 such that adjacent nucleotides are linked by a 2'-5' internucleotide bond between positions 15-16, 16-17, 17-18 and 18-19 and a 3'OH is available at the 3' terminal nucleotide or at positions 16, 17 and 18 such that adjacent nucleotides are linked by a 2'-5' internucleotide bond between positions 16-17, 17-18 and 18-19. In some embodiments x=y=19 and (N')y includes 2'-5' nucleotides at positions 16 and 17 or at positions 17 and 18 or at positions 15 and 17 such that adjacent nucleotides are linked by a 2'-5' internucleotide bond between positions 16-17 and 17-18 or between positions 17-18 and 18-19 or between positions 15-16 and 17-18, respectively. In other embodiments the pyrimidine ribonucleotides (rU, rC) in (N')y are substituted with nucleotides joined to the adjacent nucleotide by a 2'-5' internucleotide bond. In some embodiments x=y=19 and (N')y comprises five consecutive nucleotides at the 3' terminus joined by four 2'-5' linkages, specifically the linkages between the nucleotides position 15-16, 16-17, 17-18 and 18-19.

In some embodiments x=y=19 and (N')y comprises five consecutive nucleotides at the 3' terminus joined by four 2'-5' linkages and optionally further includes Z' and z' independently selected from an inverted abasic moiety and a C3 alkyl [C3; 1,3-propanediol mono(dihydrogen phosphate)] cap. In some embodiments the C3 alkyl cap is covalently linked to the 3' or 5' terminal nucleotide. In some embodiments the 3' C3 terminal cap further comprises a 3' phosphate. In some embodiments the 3' C3 terminal cap further comprises a 3' terminal hydroxyl group.

In some embodiments x=y=19 and (N')y comprises an L-DNA position 18; and (N')y optionally further includes Z' and z' independently selected from an inverted abasic moiety and a C3 alkyl [C3; 1,3-propanediol mono(dihydrogen phosphate)] cap.

In some embodiments (N')y comprises a 3' terminal phosphate (i.e. phosphorylated at the 3' terminus). In some embodiments (N')y comprises a 3' terminal hydroxyl.

In some embodiments x=y=19 and (N)x includes 2'-OMe sugar modified ribonucleotides at positions 1, 3, 5, 7, 9, 11, 13, 15, 17, 19 or at positions 2, 4, 6, 8, 11, 13, 15, 17, 19. In some embodiments x=y=19 and (N)x includes 2'-OMe sugar modified pyrimidines. In some embodiments all pyrimidines in (N)x include the 2'-OMe sugar modification.

In some embodiments of structure A2 x=y=18 and $N^2$ is a riboadenosine moiety. In some embodiments x=y=18, and $N^2$-(N')y comprises five consecutive nucleotides at the 3' terminus joined by four 2'-5' linkages, specifically the linkages between the nucleotides position 15-16, 16-17, 17-18 and 18-19. In some embodiments the linkages include phosphodiester bonds. In some embodiments x=y=18 and $N^2$-(N')y comprises five consecutive nucleotides at the 3' terminus joined by four 2'-5' linkages and optionally further includes Z' and z' independently selected from an inverted abasic moiety and a C3 alkyl [C3; 1,3-propanediol mono (dihydrogen phosphate)] cap. In some embodiments x=y=18 and $N^2$-(N')y comprises an L-DNA position 18; and (N')y optionally further includes Z' and z' independently selected from an inverted abasic moiety and a C3 alkyl [C3; 1,3-propanediol mono(dihydrogen phosphate)] cap. In some embodiments $N^2$-(N')y comprises a 3' terminal phosphate. In some embodiments $N^2$-(N')y comprises a 3' terminal hydroxyl. In some embodiments x=y=18 and $N^1$-(N)x includes 2'-OMe sugar modified ribonucleotides in positions 1, 3, 5, 7, 9, 11, 13, 15, 17, 19 or in positions 1, 3, 5, 9, 11, 13, 15, 17, 19, or in positions 3, 5, 9, 11, 13, 15, 17, or in positions 2, 4, 6, 8, 11, 13, 15, 17, 19. In some embodiments x=y=18 and $N^1$-(N)x includes 2'-OMe sugar modified ribonucleotides at positions 11, 13, 15, 17 and 19 (from 5' terminus). In some embodiments x=y=18 and N1-(N)x includes 2'-OMe sugar modified ribonucleotides in positions 1, 3, 5, 7, 9, 11, 13, 15, 17, 19 or in positions 3, 5, 7, 9, 11, 13, 15, 17, 19. In some embodiments x=y=18 and $N^1$-(N)x includes 2'-OMe sugar modified ribonucleotides in positions 2, 4, 6, 8, 11, 13, 15, 17, 19.

In some embodiments x=y=18 and $N^1$-(N)x includes 2'-OMe sugar modified pyrimidines. In some embodiments all pyrimidines in (N)x include the 2'-OMe sugar modification. In some embodiments the antisense strand further comprises an L-DNA or a 2'-5' nucleotide in position 5, 6 or 7 (5'>3'). In other embodiments the antisense strand further comprises a ribonucleotide, which generates a 2'5' internucleotide linkage in between the ribonucleotides in positions 5-6 or 6-7 (5'>3').

In additional embodiments $N^1$-(N)x further includes Z wherein Z comprises a non-nucleotide overhang. In some embodiments the non-nucleotide overhang is C3-C3 [1,3-propanediol mono(dihydrogen phosphate)]2.

In some embodiments of Structure A2, (N)y includes at least one L-DNA moiety. In some embodiments x=y=18 and (N')y consists of unmodified ribonucleotides at positions 1-16 and 18 and one L-DNA at the 3' penultimate position (position 17). In other embodiments x=y=18 and (N')y consists of unmodified ribonucleotides at position 1-15 and 18 and two consecutive L-DNA at the 3' penultimate position (positions 16 and 17). In various embodiments the unconventional moiety is a nucleotide joined to an adjacent nucleotide by a 2'-5' internucleotide phosphate linkage. According to various embodiments (N')y includes 2, 3, 4, 5, or 6 consecutive ribonucleotides at the 3' terminus linked by 2'-5' internucleotide linkages. In one embodiment, four consecutive nucleotides at the 3' terminus of (N')y are joined by three 2'-5' phosphodiester bonds, wherein one or more of the 2'-5' nucleotides which form the 2'-5' phosphodiester bonds further includes a 3'-O-methyl (3'OMe) sugar modification. Preferably the 3' terminal nucleotide of (N')y includes a 2'-OMe sugar modification. In certain embodiments x=y=18 and in (N')y two or more consecutive nucleotides at positions 14, 15, 16, 17, and 18 include a nucleotide joined to an adjacent nucleotide by a 2'-5' internucleotide bond. In various embodiments the nucleotide forming the 2'-5' internucleotide bond includes a 3' deoxyribose nucleotide or a 3' methoxy nucleotide. In some embodiments x=y=18 and (N')y includes nucleotides joined to the adjacent nucleotide by a 2'-5' internucleotide bond between positions 15-16, 16-17 and 17-18 or between positions 16-17 and 17-18. In some embodiments x=y=18 and (N')y includes nucleotides joined to the adjacent nucleotide by a 2'-5' internucleotide bond between positions 14-15, 15-16, 16-17, and 17-18 or between positions 15-16, 16-17, and 17-18 or between positions 16-17 and 17-18 or between positions 17-18 or between positions 15-16 and 17-18. In other embodiments the pyrimidine ribonucleotides (rU, rC) in (N')y are substituted with nucleotides joined to the adjacent nucleotide by a 2'-5' internucleotide bond.

In some embodiments of Structure A1 and Structure A2 each N consists of an unmodified ribonucleotide. In some embodiments of Structure A1 and Structure A2 each N' consists of an unmodified nucleotide. In preferred embodiments, at least one of N and N' is a modified ribonucleotide or an unconventional moiety.

In other embodiments the molecule of Structure A1 or Structure A2 includes at least one ribonucleotide modified in the sugar residue. In some embodiments the compound includes a modification at the 2' position of the sugar residue. In some embodiments the modification at the 2' position includes the presence of an amino, a fluoro, an alkoxy or an alkyl moiety. In certain embodiments the 2' modification includes an alkoxy moiety, In preferred embodiments the alkoxy moiety is a methoxy moiety (also known as 2'-O-methyl; 2'-OMe; 2'-OCH3). In some embodiments the nucleic acid compound includes 2'-OMe sugar modified alternating ribonucleotides in one or both of the antisense and the sense strands. In other embodiments the compound includes 2'-OMe sugar modified ribonucleotides in the antisense strand, (N)x or N1-(N)x, only. In certain embodiments the middle ribonucleotide of the antisense strand; e.g. ribonucleotide in position 10 in a 19-mer strand is unmodified. In various embodiments the nucleic acid compound includes at least 5 alternating 2'-OMe sugar modified and unmodified ribonucleotides.

In additional embodiments the compound of Structure A1 or Structure A2 includes modified ribonucleotides in alternating positions wherein each ribonucleotide at the 5' and 3' termini of (N)x or N1-(N)x are modified in their sugar residues, and each ribonucleotide at the 5' and 3' termini of (N')y or $N^2$-(N)y are unmodified in their sugar residues.

In some embodiments, (N)x or $N^1$-(N)x includes 2'-OMe modified ribonucleotides at positions 2, 4, 6, 8, 11, 13, 15, 17 and 19. In other embodiments (N)x (N)x or $N^1$-(N)x includes 2'-OMe modified ribonucleotides at positions 1, 3, 5, 7, 9, 11, 13, 15, 17 and 19. In some embodiments (N)x or $N^1$-(N)x includes 2'-OMe modified pyrimidines. In some embodiments all the pyrimidine nucleotides in (N)x or $N^1$-(N)x are 2'-OMe modified. In some embodiments (N')y or $N^2$-(N')y includes 2'-OMe modified pyrimidines. In additional embodiments the compound of Structure A1 or Structure A2 includes modified ribonucleotides in alternating positions wherein each ribonucleotide at the 5' and 3' termini of (N)x or $N^1$-(N)x are modified in their sugar residues, and each ribonucleotide at the 5' and 3' termini of (N')y or $N^2$-(N)y are unmodified in their sugar residues.

The nucleic acid molecules disclosed herein may have a blunt end on one end, for example when Z and z" are absent or wherein Z' is absent. The nucleic acid molecule may be modified with modified nucleotides or unconventional moieties that may be located at any position along either the sense or antisense strand. The nucleic acid molecule may include about 1, 2, 3, 4, 5, 6, 7, 8, 9, 10, 11, 12, 13, 14, or 15 modified nucleotides. The nucleic acid molecule may include about 1, 2, 3, 4, 5, 6, 7, or 8 unconventional moieties. The nucleic acid molecule may include a group of about 1, 2, 3, 4, 5, 6, 7, or 8, preferably 1, 2, 3 or 4 contiguous modified nucleotides or unconventional moieties. Modified nucleic acids may be present in the sense strand only, the antisense strand only, or in both the sense strand and the antisense strand. In some embodiments the modified nucleotide comprises a 2' sugar modified nucleotide, including 2'O-methyl modified nucleotide, 2' deoxyfluoro modified nucleotide, 2'-amino modified nucleotide. In some embodiments the unconventional moiety comprises a mirror nucleotide (i.e. L-DNA or L-RNA) or a nucleotide able to form a 2'-5' linkage (2'5' nucleotide).

As used herein, the term "duplex region" refers to the region in the double stranded molecule in which two complementary or substantially complementary oligonucleotides form base pairs with one another, typically by Watson-Crick base pairing or by any other manner that allows for a duplex formation. For example, an oligonucleotide strand having 19 nucleotide units can base pair with a complementary oligonucleotide of 19 nucleotide units, or can base pair with 15, 16 17 or 18 bases on each strand such that the "duplex region" consists of 15, 16 17 or 18 base pairs. The remaining base pairs may, for example, exist as 5' and 3' overhangs. Further, within the duplex region, 100% complementarity is not required; substantial complementarity is allowable within a duplex region. The overhang region may consist of nucleotide or non-nucleotide moieties. As disclosed herein at least one overhang region consists of one or more non-nucleotide moieties.

Generic non-limiting nucleic acid molecule patterns are shown below where N'=sense strand nucleotide in the duplex region; z"=5'-capping moiety covalently attached at the 5' terminus of the sense strand; C3=3 carbon non-nucleotide moiety; N=antisense strand nucleotide in the duplex region; idB=inverted abasic deoxyribonucleotide non-nucleotide moiety. Each N, N', is independently modified or unmodified or an unconventional moiety. The sense and antisense strands are each independently 18-40 nucleotides in length. The examples provided below have a duplex region of 19 nucleotides; however, nucleic acid molecules disclosed herein can have a duplex region anywhere between 18 and 40 nucleotides and where each strand is independently between 18 and 40 nucleotides in length. In each duplex the antisense strand (N)x is shown on top. The preferred 19-mer sense sequences and antisense sequences useful in generating dsRNA according to Structure A1 are set forth in SEQ ID NOS:13-3060 (targeting TLR2), SEQ ID NOS:5847-8612 (targeting TLR4), SEQ ID NOS:12145-13924 (targeting MYD88), SEQ ID NOS:16333-16882 (targeting TICAM1) and SEQ ID NOS:18243-19046 (targeting TIRAP). The preferred 18-mer sense sequences and antisense sequences useful in generating dsRNA according to Structure A2 are set forth in SEQ ID NOS: 3061-5846 (targeting TLR2), SEQ ID NOS: 8613-12144 (targeting TLR4), SEQ ID NOS: 13925-16332 (targeting MYD88), SEQ ID NOS:16883-18242 (targeting TICAM1) and SEQ ID NOS: 19047-20606 (targeting TIRAP). Certain preferred oligonucleotide pairs useful in generating dsNA are set forth in Tables 1-5.

In some embodiments a double stranded nucleic acid molecule has the following structure, wherein each N or N' comprises an unmodified or modified ribonucleotide, or an unconventional moiety:

```
5'            N N N N N N N N N N N N N N N N N N-C3Pi-C3Pi
3'            N'N'N'N'N'N'N'N'N'N'N'N'N'N'N'N'N'N
or

5'            N N N N N N N N N N N N N N N N N N-C3Pi-C3Pi
3'            N'N'N'N'N'N'N'N'N'N'N'N'N'N'N'N'N'N'-z"
or

5'            N N N N N N N N N N N N N N N N N N-C3Pi-C3Pi
3'  PiC3-PiC3- N'N'N'N'N'N'N'N'N'N'N'N'N'N'N'N'N'N'
or

5'            N N N N N N N N N N N N N N N N N N-C3Pi-C3Pi
3'  PiC3-PiC3- N'N'N'N'N'N'N'N'N'N'N'N'N'N'N'N'N'N'-z"
or

5'            N N N N N N N N N N N N N N N N N N-C3Pi-C3Pi
3'       PiC3- N'N'N'N'N'N'N'N'N'N'N'N'N'N'N'N'N'N'
or

5'            N N N N N N N N N N N N N N N N N N-C3Pi-C3Pi
3'       PiC3- N'N'N'N'N'N'N'N'N'N'N'N'N'N'N'N'N'N'-z"
or

5'            N N N N N N N N N N N N N N N N N N-C3Pi-C3Pi
3'       HOC3- N'N'N'N'N'N'N'N'N'N'N'N'N'N'N'N'N'N'
or

5'            N N N N N N N N N N N N N N N N N N-C3Pi-C3Pi
3'       HOC3- N'N'N'N'N'N'N'N'N'N'N'N'N'N'N'N'N'N'-z"
or

5'            N N N N N N N N N N N N N N N N N N-aB-aB
3'            N'N'N'N'N'N'N'N'N'N'N'N'N'N'N'N'N'N'
or

5'            N N N N N N N N N N N N N N N N N N-aB-aB
3'            N'N'N'N'N'N'N'N'N'N'N'N'N'N'N'N'N'N'-z"
or

5'            N N N N N N N N N N N N N N N N N N-idB-idB
3'       aB-aB- N'N'N'N'N'N'N'N'N'N'N'N'N'N'N'N'N'N'
or

5'            N N N N N N N N N N N N N N N N N N-aB-aB
3'       aB-aB- N'N'N'N'N'N'N'N'N'N'N'N'N'N'N'N'N'N'-z"
or

5'            N N N N N N N N N N N N N N N N N N-C3Pi-C3Pi
3'       PiC3- N'N'N'N'N'N'N'N'N'N'N'N'N'N'N'N'N'N
or

5'            N N N N N N N N N N N N N N N N N N-C3Pi-C3Pi
3'       aB-aB- N'N'N'N'N'N'N'N'N'N'N'N'N'N'N'N'N'N'
or

5'            N N N N N N N N N N N N N N N N N N-C3Pi-C3OH
3'            N'N'N'N'N'N'N'N'N'N'N'N'N'N'N'N'N'N
or

5'            N N N N N N N N N N N N N N N N N N-C3Pi-C3OH
3'            N'N'N'N'N'N'N'N'N'N'N'N'N'N'N'N'N'N'-z"
or
```

-continued

```
5'                 N N N N N N N N N N N N N N N N N N-C3Pi-C3OH
3'    PiC3-PiC3-   N'N'N'N'N'N'N'N'N'N'N'N'N'N'N'N'N'N'
or

5'                 N N N N N N N N N N N N N N N N N N-C3Pi-C3OH
3'    PiC3-PiC3-   N'N'N'N'N'N'N'N'N'N'N'N'N'N'N'N'N'N'-z"
or

5'                 N N N N N N N N N N N N N N N N N N-C3Pi-C3OH
3'         PiC3-   N'N'N'N'N'N'N'N'N'N'N'N'N'N'N'N'N'N'
or

5'                 N N N N N N N N N N N N N N N N N N-C3Pi-C3OH
3'         PiC3-   N'N'N'N'N'N'N'N'N'N'N'N'N'N'N'N'N'N'-z"
or

5'                 N N N N N N N N N N N N N N N N N N-C3Pi-C3OH
3'         HOC3-   N'N'N'N'N'N'N'N'N'N'N'N'N'N'N'N'N'N'
or

5'                 N N N N N N N N N N N N N N N N N N-C3Pi-C3OH
3'         HOC3-   N'N'N'N'N'N'N'N'N'N'N'N'N'N'N'N'N'N'-z"
or

5'                 N N N N N N N N N N N N N N N N N N-C3Pi-C3Ps
3'                 N'N'N'N'N'N'N'N'N'N'N'N'N'N'N'N'N'N
or

5'                 N N N N N N N N N N N N N N N N N N-C3Pi-C3Ps
3'                 N'N'N'N'N'N'N'N'N'N'N'N'N'N'N'N'N'N'-z"
or

5'                 N N N N N N N N N N N N N N N N N N-C3Pi-C3Ps
3'    OHC3-PiC3-   N'N'N'N'N'N'N'N'N'N'N'N'N'N'N'N'N'N'
or

5'                 N N N N N N N N N N N N N N N N N N-C3Pi-C3Ps
3'    OHC3-PiC3-   N'N'N'N'N'N'N'N'N'N'N'N'N'N'N'N'N'N'-z"
```

In some preferred embodiment nucleic acid molecules disclosed herein have the following structure

```
5' N N N N N N N N N N N N N N N N N

N-C3Pi-C3OH

3' HOC3-N'N'N'N'N'N'N'N'N'N'N'N'N'N'N'N'N'N'-z"
or
5' N N N N N N N N N N N N N N N N N

N-C3Pi-C3OH

3' iPC3-N'N'N'N'N'N'N'N'N'N'N'N'N'N'N'N'N'N'-z"
``` wherein of N and N' is independently a ribonucleotide which may be unmodified or modified, or is an unconventional moiety;
wherein each N is linked to the adjacent N by a covalent bond;
wherein each N' is linked to the adjacent N' by a covalent bond; and
wherein z" is a capping moiety covalently attached to the 5' terminus of the sense strand.

The term "aB" refers to an abasic moiety which can be riboabasic moiety or a deoxyriboabasic moiety, or an inverted riboabasic moiety or an inverted deoxyriboabasic moiety.

In some embodiments the nucleic acid molecules disclosed herein comprise Z. In other embodiments the nucleic acid molecules disclosed herein comprise Z'. In additional embodiments both Z and Z' are present. In some embodiments Z and Z' are both present and identical. In further embodiments both Z and Z' are present and are different. In some embodiments Z and Z' independently comprise 1 or 2 non-nucleotide moieties. In some embodiments Z and Z' independently comprise 2 non-nucleotide moieties.

In some embodiments Z is present and comprises one or more non-nucleotide moieties selected from an abasic moiety an inverted abasic moiety, an alkyl moiety or derivative thereof, and an inorganic phosphate moiety.

In additional embodiments Z' is present and comprises one or more non-nucleotide moieties selected from an abasic moiety an inverted abasic moiety, an alkyl moiety or derivative thereof or an inorganic phosphate moiety.

In additional embodiments Z and/or Z' are present and independently comprise a combination of one or more nucleotide and one or more non-nucleotide moiety selected from the moieties disclosed herein.

In some embodiments each of Z and Z' includes an abasic moiety, optionally deoxyriboabasic (referred to herein as "dAb") or riboabasic (referred to herein as "rAb") nucleotides. In some embodiments each of Z and/or Z' is dAb-dAb or rAb-rAb.

In some embodiments each of Z and/or Z' independently includes an alkyl moiety, optionally a phosphodiester derivative of propanediol ((CH2)3-Pi, referred to herein also as "C3Pi") modified moiety. In some embodiments Z and/or Z' are C3Pi-C3Pi. In a specific embodiment x=y=19 and Z comprises two propanediol derivatives, C3-C3 (i.e. —C3-Pi-C3-Pi). In various embodiments the C3 moiety is covalently linked to the 3' terminus of the sense or antisense strand via a phosphodiester bond.

In additional embodiments Z and/or Z' comprise a combination of one or more abasic moieties and unmodified nucleotides or a combination of one or more hydrocarbon moieties and unmodified nucleotides or a combination of one or more abasic and hydrocarbon moieties. In such embodiments, Z and/or Z' are optionally C3-rAb or C3-dAb.

In further embodiments relating to structure A1 or A2, the nucleic acid molecules further comprises 2'-OMe sugar modified ribonucleotides at positions 2, 4, 6, 8, 11, 13, 15, 17 and 19 of the antisense strand. In additional embodiments the compound also comprises an L-DNA nucleotide at position 18 of the sense strand. In additional embodiments the compound comprises a nucleotide joined to an adjacent nucleotide by a 2'-5' internucleotide phosphate bond. In additional embodiments x=y=19 and the nucleotides at positions 15-19 or 16-19 or 17-19 in (N')y are joined to adjacent nucleotides by 2'-5' internucleotide phosphate bonds. In some embodiments x=y=19 and the nucleotides at positions 15-19 or 16-19 or 17-19 or 15-18 or 16-18 in (N')y are joined to the adjacent nucleotides by 2'-5' internucleotide phosphate bonds.

According to certain embodiments provided herein are dsRNA compounds, such as siRNA compounds further comprising one or more modified nucleotide, wherein the modified nucleotide possesses a modification in the sugar moiety, in the base moiety or in the internucleotide linkage moiety.

In some embodiments (N)x comprises modified and unmodified ribonucleotides, each modified ribonucleotide a 2'-OMe sugar modified ribonucleotide, wherein N at the 3' terminus of (N)x is a modified ribonucleotide, (N)x comprises at least five alternating modified ribonucleotides beginning at the 3' end and at least nine modified ribonucleotides in total and each remaining N is an unmodified ribonucleotide.

In some embodiments at least one of (N)x and (N')y comprises at least one mirror nucleotide. In some embodiments in (N')y at least one unconventional moiety is present, which unconventional moiety may be an abasic ribose moiety, an abasic deoxyribose moiety, a modified or unmodified deoxyribonucleotide, a mirror nucleotide, and a nucleotide joined to an adjacent nucleotide by a 2'-5' internucleotide phosphate bond, or any other unconventional moiety disclosed herein.

In some embodiments an unconventional moiety is an L-DNA mirror nucleotide; in additional embodiments at least one unconventional moiety is present at positions 15, 16, 17, or 18 in (N')y. In some embodiments the unconventional moiety is selected from a mirror nucleotide, an abasic ribose moiety and an abasic deoxyribose moiety. In some embodiments the unconventional moiety is a mirror nucleotide, preferably an L-DNA moiety. In some embodiments the L-DNA moiety is present at position 17, position 18 or positions 17 and 18.

In some embodiments (N)x comprises nine alternating modified ribonucleotides. In other embodiments (N)x comprises nine alternating modified ribonucleotides further comprising a 2' modified nucleotide at position 2. In some embodiments (N)x comprises 2'-OMe modified ribonucleotides at the odd numbered positions 1, 3, 5, 7, 9, 11, 13, 15, 17, 19. In other embodiments (N)x further comprises a 2'-OMe sugar modified ribonucleotide at one or both of positions 2 and 18. In yet other embodiments (N)x comprises 2'-OMe sugar modified ribonucleotides at positions 2, 4, 6, 8, 11, 13, 15, 17, 19. In some embodiments at least one pyrimidine ribonucleotide in (N)x comprises a 2'-OMe sugar modification. In some embodiments all pyrimidine ribonucleotides in (N)x comprises a 2'-OMe sugar modification. In some embodiments 2, 3, 4, 5, 6, 7, 8, 9, 1'0, 11, 12, 13, 14, or 15 pyrimidine ribonucleotides in N(x) comprise a 2'-OMe sugar modification In various embodiments z" is present and is selected from an abasic ribose moiety, a deoxyribose moiety; an inverted abasic ribose moiety, a deoxyribose moiety; C6-amino-Pi; a mirror nucleotide.

In one embodiment of the nucleic acid molecules (N')y comprises at least two nucleotides at either or both the 5' and 3' termini of (N')y are joined by a 2'-5' phosphodiester bond. In certain embodiments x=y=19; in (N)x the nucleotides alternate between modified ribonucleotides and unmodified ribonucleotides, each modified ribonucleotide being a 2'-OMe sugar modified ribonucleotide located at the middle of (N)x being unmodified; and three nucleotides at the 3' terminus of (N')y are joined by two 2'-5' phosphodiester bonds. In other embodiments, x=y=19; in (N)x the nucleotides alternate between modified ribonucleotides and unmodified ribonucleotides, each modified ribonucleotide a 2'-OMe sugar modified ribonucleotide located at the middle of (N)x being unmodified; and four consecutive nucleotides at the 5' terminus of (N')y are joined by three 2'-5' phosphodiester bonds. In a further embodiment, an additional nucleotide located in the middle position of (N)y may be a 2'-OMe sugar modified ribonucleotide. In another embodiment, in (N)x the nucleotides alternate between 2'-OMe sugar modified ribonucleotides and unmodified ribonucleotides, and in (N')y four consecutive nucleotides at the 5' terminus are joined by three 2'-5' phosphodiester bonds and the 5' terminal nucleotide or two or three consecutive nucleotides at the 5' terminus comprise 3'-O-Me sugar modifications.

In certain embodiments of Structure (A1), x=y=19 and in (N')y the nucleotide in at least one position comprises a mirror nucleotide, a deoxyribonucleotide and a nucleotide joined to an adjacent nucleotide by a 2'-5' internucleotide bond.

In certain embodiments of Structure (A1), x=y=19 and (N')y comprises a mirror nucleotide. In various embodiments the mirror nucleotide is an L-DNA nucleotide. In certain embodiments the L-DNA is L-deoxyribocytidine. In some embodiments (N')y comprises L-DNA at position 18. In other embodiments (N')y comprises L-DNA at positions 17 and 18. In certain embodiments (N')y comprises L-DNA substitutions at positions 2 and at one or both of positions 17 and 18. Other embodiments of Structure (A1) are envisaged in wherein x=y=21 or wherein x=y=23; in these embodiments the modifications for (N')y discussed above instead of being on positions 15, 16, 17, 18 are on positions 17, 18, 19, 20 for 21 mer and on positions 19, 20, 21, 22 for 23 mer; similarly the modifications at one or both of positions 17 and 18 are on one or both of positions 19 or 20 for the 21 mer and one or both of positions 21 and 22 for the 23 mer. All modifications in the 19 mer are similarly adjusted for the 21 and 23 mers.

According to various embodiments of Structure A1 or A2 in 2, 3, 4, 5, 6, 7, 8, 9, 10, 11, 12, 13 or 14 consecutive ribonucleotides at the 3' terminus in (N')y or N2-(N')y are linked by 2'-5' internucleotide linkages In one embodiment, four consecutive nucleotides at the 3' terminus of (N')y are joined by three 2'-5' phosphodiester bonds, wherein one or more of the 2'-5' nucleotides which form the 2'-5' phosphodiester bonds further comprises a 3'-O-methyl sugar modification. Preferably the 3' terminal nucleotide of (N')y comprises a 2'-O-methyl sugar modification. In certain embodiments of Structure (A1), x=y=19 and in (N')y two or more consecutive nucleotides at positions 15, 16, 17, 18 and 19 comprise a nucleotide joined to an adjacent nucleotide by a 2'-5' internucleotide bond. In various embodiments the nucleotide forming the 2'-5' internucleotide bond comprises a 3' deoxyribose nucleotide or a 3' methoxy nucleotide. In some embodiments the nucleotides at positions 17 and 18 in (N')y are joined by a 2'-5' internucleotide bond. In other embodiments the nucleotides at positions 16, 17, 18, 16-17, 17-18, or 16-18 in (N')y are joined by a 2'-5' internucleotide bond.

In certain embodiments (N')y comprises an L-DNA at position 2 and 2'-5' internucleotide bonds at positions 16, 17, 18, 16-17, 17-18, or 16-18. In certain embodiments (N')y comprises 2'-5' internucleotide bonds at positions 16, 17, 18, 16-17, 17-18, or 16-18 and a 5' terminal cap nucleotide.

In one embodiment of the nucleic acid molecules, the 3' terminal nucleotide or two or three consecutive nucleotides at the 3' terminus of (N')y are L-deoxyribonucleotides.

In other embodiments the nucleic acid molecules, in (N')y 2, 3, 4, 5, 6, 7, 8, 9, 10, 11, 12, 13 or 14 consecutive ribonucleotides at either terminus or 2-8 modified nucleotides at each of the 5' and 3' termini are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In one embodiment, three, four or five consecutive nucleotides at the 5' terminus of (N')y comprise the 2'-OMe modification. In another embodiment, three consecutive nucleotides at the 3' terminus of (N')y comprise the 2'-OMe sugar modification.

In some embodiments of Structure A1 or A2 in (N')y or N2-(N')y or more, consecutive ribonucleotides at either terminus or 2-8 modified nucleotides at each of the 5' and 3' termini are independently bicyclic nucleotide. In various embodiments the bicyclic nucleotide is a locked nucleic acid (LNA). A 2'-O, 4'-C-ethylene-bridged nucleic acid (ENA) is a species of LNA.

In various embodiments (N')y or N2-(N')y comprises modified nucleotides at the 5' terminus or at both the 3' and 5' termini.

In some embodiments of Structure A1 or A2 at least two nucleotides at either or both the 5' and 3' termini of (N')y are joined by P-ethoxy backbone modifications. In certain embodiments x=y=19 or x=y=23; in (N)x the nucleotides alternate between modified ribonucleotides and unmodified ribonucleotides, each modified ribonucleotide being a 2'-OMe sugar modified ribonucleotide and the ribonucleotide located at the middle position of (N)x being unmodified; and four consecutive nucleotides at the 3' terminus or at the 5' terminus of (N')y are joined by three P-ethoxy backbone modifications. In another embodiment, three consecutive nucleotides at the 3' terminus or at the 5' terminus of (N')y are joined by two P-ethoxy backbone modifications.

In some embodiments of Structure A1 or A2 in (N')y or N2-(N')y 2, 3, 4, 5, 6, 7 or 8, consecutive ribonucleotides at each of the 5' and 3' termini are independently mirror nucleotides, nucleotides joined by 2'-5' phosphodiester bond, 2'-OMe sugar modified nucleotides or bicyclic nucleotide. In one embodiment, the modification at the 5' and 3' termini of (N')y is identical. In one embodiment, four consecutive nucleotides at the 5' terminus of (N')y are joined by three 2'-5' phosphodiester bonds and three consecutive nucleotides at the 3' terminus of (N')y are joined by two 2'-5' phosphodiester bonds. In another embodiment, the modification at the 5' terminus of (N')y is different from the modification at the 3' terminus of (N')y. In one embodiment, the modified nucleotides at the 5' terminus of (N')y are mirror nucleotides and the modified nucleotides at the 3' terminus of (N')y are joined by 2'-5' phosphodiester bond. In another specific embodiment, three consecutive nucleotides at the 5' terminus of (N')y are LNA nucleotides and three consecutive nucleotides at the 3' terminus of (N')y are joined by two 2'-5' phosphodiester bonds. In (N)x the nucleotides alternate between modified ribonucleotides and unmodified ribonucleotides, each modified ribonucleotide being a 2'-OMe sugar modified ribonucleotide and the ribonucleotide located at the middle of (N)x being unmodified, or the ribonucleotides in (N)x being unmodified In another embodiment of Structure A1 provided herein are compounds wherein x=y=19; in (N)x the nucleotides alternate between modified ribonucleotides and unmodified ribonucleotides, each modified ribonucleotide being modified to a 2'-OMe sugar modified ribonucleotide and the ribonucleotide located at the middle of (N)x being unmodified; three nucleotides at the 3' terminus of (N')y are joined by two 2'-5' phosphodiester bonds and three nucleotides at the 5' terminus of (N')y are LNA such as ENA; and Z and/or Z' independently comprise one or more non-nucleotide moiety selected from the group consisting of an abasic moiety, an inverted abasic moiety, a hydrocarbon moiety, and an inorganic phosphate, or a combination of one or more non-nucleotide moiety and one or more nucleotide. In some embodiments Z is selected from C3Pi-C3Pi, C3Pi-C3OH; C3Pi-rAb; C3Pi-dAb; dAb-dAb and rAb-rAb.

In another embodiment five consecutive nucleotides at the 5' terminus of (N')y or N2-(N')y comprise the 2'-O-methyl sugar modification and two consecutive nucleotides at the 3' terminus of (N')y are L-DNA.

According to other embodiments in N')y or N2-(N')y the 5' or 3' terminal nucleotide, or 2, 3, 4, 5 or 6 consecutive nucleotides at either termini or 1-4 modified nucleotides at each of the 5' and 3' termini are independently phosphonocarboxylate or phosphinocarboxylate nucleotides (PACE nucleotides). In some embodiments the PACE nucleotides are deoxyribonucleotides. In some embodiments in N')y or N2-(N')y, 1 or 2 consecutive nucleotides at each of the 5' and 3' termini are PACE nucleotides. Examples of PACE nucleotides and analogs are disclosed in U.S. Pat. Nos. 6,693,187 and 7,067,641 both incorporated by reference.

In one embodiment of Structure (A1), x=y=19; (N)x comprises unmodified ribonucleotides in which two consecutive nucleotides linked by one 2'-5' internucleotide linkage at the 3' terminus; (N')y comprises unmodified ribonucleotides in which two consecutive nucleotides linked by one 2'-5' internucleotide linkage at the 5' terminus; and Z and/or Z' independently comprise one or more non-nucleotide moiety selected from the group consisting of an abasic moiety, an inverted abasic moiety, a hydrocarbon moiety, and an inorganic phosphate, or a combination of one or more non-nucleotide moiety and one or more nucleotide. In some embodiments Z is selected from C3Pi-C3Ps; C3Pi-C3OH; C3Pi-C3Pi; C3Pi-rAb; C3Pi-dAb; dAb-dAb and rAb-rAb, each C3, rAb, dAb covalently linked to the adjacent C3Pi, rAb, dAb via a phospho-based bond. In some embodiments the phospho-based bond is a phosphodiester bond or a phosphorothiophosphate bond.

In some embodiments, x=y=19; (N)x comprises unmodified ribonucleotides in which three consecutive nucleotides at the 3' terminus are joined together by two 2'-5' phosphodiester bonds; (N')y comprises unmodified ribonucleotides in which four consecutive nucleotides at the 5' terminus are joined together by three 2'-5' phosphodiester bonds; and. Z and/or Z' independently comprise one or more non-nucleotide moiety selected from the group consisting of an abasic moiety, an inverted abasic moiety, a hydrocarbon moiety, and an inorganic phosphate, or a combination of one or more non-nucleotide moiety and one or more nucleotide. In some embodiments Z is selected from C3Pi-C3Ps; C3Pi-C3OH; C3Pi-C3Pi; C3Pi-rAb; C3Pi-dAb; dAb-dAb and rAb-rAb wherein each C3Pi, rAb, dAb covalently linked to the adjacent C3Pi, rAb, dAb via a phospho-based bond. In some embodiments the phospho-based bond is a phosphodiester bond or a phosphorothiophosphate bond.

According to one embodiment of Structure A1 or A2 four consecutive nucleotides at the 5' terminus of (N')y or (N')y-N2, respectively are joined by three 2'-5' phosphodiester bonds; three consecutive nucleotides at the 3' terminus of (N')x are joined by two 2'-5' phosphodiester bonds; and Z and/or Z' independently comprise one or more non-nucleotide moiety selected from the group consisting of an abasic moiety, an inverted abasic moiety, a hydrocarbon moiety, and an inorganic phosphate, or a combination of one or more non-nucleotide moiety and one or more nucleotide. In some embodiments Z is selected from C3Pi-C3Ps; C3Pi-C3OH; C3Pi-C3Pi; C3Pi-rAb; C3Pi-dAb; C3-dAb; dAb-dAb and rAb-rAb. Three nucleotides at the 5' terminus of (N')y and two nucleotides at the 3' terminus of (N')x may also comprise 3'-O-Me sugar modifications.

In one embodiment of Structure A1 or A2, five consecutive nucleotides at the 5' terminus of (N')y or (N')y-N2, respectively comprise the 2'-O-Me sugar modification and five consecutive nucleotides at the 3' terminus of (N')x comprise the 2'-O-Me sugar modification. In another embodiment ten consecutive nucleotides at the 5' terminus of (N')y comprise the 2'-O-Me sugar modification and five consecutive nucleotides at the 3' terminus of (N')x comprise the 2'-O-Me sugar modification. In another embodiment thirteen consecutive nucleotides at the 5' terminus of (N')y comprise the 2'-O-Me sugar modification; five consecutive nucleotides at the 3' terminus of (N')x comprise the 2'-O-Me sugar modification; and Z and/or Z' independently comprise one or more non-nucleotide moiety selected from the group consisting of an abasic moiety, an inverted abasic moiety, a hydrocarbon moiety, and an inorganic phosphate, or a combination of one or more non-nucleotide moiety and one or more nucleotide. In some embodiments Z is selected C3Pi-C3Ps; C3Pi-C3OH; C3Pi-C3Pi; C3Pi-rAb; C3Pi-dAb; dAb-dAb and rAb-rAb.

In specific embodiments five consecutive nucleotides at the 5' terminus of (N')y or (N')y-N2, respectively comprise the 2'-O-Me sugar modification and two consecutive nucleotides at the 3' terminus of (N')y are L-DNA. In addition, the compound may further comprise five consecutive 2'-O-methyl modified nucleotides at the 3' terminus of (N')x and Z and/or Z' may independently comprise one or more non-nucleotide moiety selected from the group consisting of an abasic moiety, an inverted abasic moiety, a hydrocarbon moiety, and an inorganic phosphate, or a combination of one or more non-nucleotide moiety and one or more nucleotide. In some embodiments Z is selected from C3Pi-C3Ps; C3Pi-C3OH; C3Pi-C3Pi; C3Pi-rAb; C3Pi-dAb; dAb-dAb and rAb-rAb.

In various embodiments of Structure A1 or A2 the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In some embodiments N'(y) comprises 2, 3, 4, 5, 6, 7, or 8 nucleotides joined to an adjacent nucleotide by a 2'-5' internucleotide bond at the 3' terminus. In some embodiments N'(y) comprises 2, 3, 4, 5, 6, 7, or 8 nucleotides joined to an adjacent nucleotide by a 2'-5' internucleotide bond at the 3' penultimate position. In some embodiments x=y=19 and N'(y) comprises 2, 3, 4, or 5 nucleotides joined to an adjacent nucleotide by a 2'-5' internucleotide bond at the 3' terminus. In some embodiments x=y=19 and N'(y) comprises 5 nucleotides joined to an adjacent nucleotide by a 2'-5' internucleotide bond at the 3' terminus i.e. in position 15, 16, 17, 18 and 19 (5'>3'). In some embodiments (N)x comprises 2'-OMe sugar modified ribonucleotides. In some embodiments (N)x comprises 2'-OMe sugar modified pyrimidine ribonucleotides. In some embodiments (N)x comprises 2'-OMe sugar modified ribonucleotides alternating with unmodified ribonucleotides. In some embodiments x=y=19 and (N)x comprises 2'-OMe sugar modified ribonucleotides in position (5'>3') 3, 5 and 11, 13, 15, 17, and 19. In some embodiments (N)x further comprises a mirror nucleotide or a 2'5' nucleotide in positions 6 or 7.

In some embodiments the sequence of (N)x has complementarity to the sequence of (N')y; and the sequence of (N')y has identity to a sequence within an mRNA encoded by a target gene.

In some preferred embodiment nucleic acid molecules disclosed herein have the following structure

```
5' N N N N N N N N N N N N N N N N N N N

N-C3Pi-C3OH

3' HOC3-N'N'N'N'N'N'N'N'N'N'N'N'N'N'N'N'N'N'N'-z"
or

5' N N N N N N N N N N N N N N N N N N N

N-C3Pi-C3OH

3' iPC3-N'N'N'N'N'N'N'N'N'N'N'N'N'N'N'N'N'N'N'-z"
``` wherein of N and N' is independently a ribonucleotide which may be unmodified or modified, or is an unconventional moiety;

wherein each N is linked to the adjacent N by a covalent bond;

wherein each N' is linked to the adjacent N' by a covalent bond;

wherein 1 to 10 of N are 2'-O Me sugar modified ribonucleotides;

wherein N at position 5, 6, 7, 8 or 9 (5'>3') is a 2'5 nucleotide or a mirror nucleotide;

wherein N' at positions 15-19 (5'>3') are 2'5' ribonucleotides;

wherein z" is a capping moiety covalently attached to the 5' terminus of the sense strand.

In some preferred embodiment nucleic acid molecules disclosed herein have the following structure

```
5' N N N N N N N N N N N N N N N N N N N

N-C3Pi-C3OH

3' HOC3-N'N'N'N'N'N'N'N'N'N'N'N'N'N'N'N'N'N'N'-z"
or

5' N N N N N N N N N N N N N N N N N N N

N-C3Pi-C3OH

3' iPC3-N'N'N'N'N'N'N'N'N'N'N'N'N'N'N'N'N'N N'-z"
``` wherein of N and N' is independently a ribonucleotide which may be unmodified or modified, or is an unconventional moiety;

wherein each N is linked to the adjacent N by a covalent bond;
wherein each N' is linked to the adjacent N' by a covalent bond;
wherein 1 to 10 of N are 2'-O Me sugar modified ribonucleotides;
wherein N at position 5, 6, 7, 8 or 9 (5'>3') is a 2'5 nucleotide or a mirror nucleotide;
wherein N' comprises one or more 2'-O Me sugar modified pyrimidine ribonucleotides;
wherein N at position 9 or 10 (5'>3') is a 2'5 nucleotide; and
wherein z" is a capping moiety covalently attached to the 5' terminus of the sense strand.

In some embodiments of Structures (A1-A2), either the sense strand or the antisense strand or both the sense strand and the antisense strand comprise an inorganic phosphate moieties at the 3' termini.

In some embodiments of the double stranded nucleic acid molecules, N at the 3' terminus is a modified ribonucleotide and (N)x comprises at least 8 modified ribonucleotides. In some embodiments the modified ribonucleotides comprise 2'-OMe sugar modified ribonucleotides. In other embodiments at least 5 of the at least 8 modified ribonucleotides are alternating beginning at the 3' end.

In some embodiments of the double stranded nucleic acid molecules z" is present and is selected from an abasic ribose moiety, a deoxyribose moiety; an inverted abasic ribose moiety, a deoxyribose moiety; C6-amino-Pi; a mirror nucleotide.

In some embodiments of the double stranded nucleic acid molecules in (N')y at least one additional unconventional moiety is present, which unconventional moiety may be an abasic ribose moiety, an abasic deoxyribose moiety, a modified or unmodified deoxyribonucleotide, a mirror nucleotide, a non-base pairing nucleotide analog or a nucleotide joined to an adjacent nucleotide by a 2'-5' internucleotide phosphate bond. In some embodiments, neither (N)x nor (N')y are phosphorylated at the 3' and 5' termini. In other embodiments either or both (N)x and (N')y are phosphorylated at the 3' termini. In yet another embodiment, either or both (N)x and (N')y are phosphorylated at the 3' termini using non-cleavable phosphate groups. In yet another embodiment, either or both (N)x and (N')y are phosphorylated at the terminal 2' termini position using cleavable or non-cleavable phosphate groups.

In certain embodiments for all of the above-mentioned structures, Z is present. In other embodiments Z' is present. In additional embodiments both Z and Z' are present. In some embodiments Z and Z' are both present and identical. In further embodiments both Z and Z' are present and are different. In some embodiments Z and Z' are independently 1, 2, 3, 4 or 5 non-nucleotide moieties, or a combination of a non-nucleotide moiety and a nucleotide.

In some embodiments Z is present and comprises one or more non-nucleotide moiety selected from an abasic moiety, an inverted abasic moiety, a hydrocarbon moiety such as $(CH_2)_3$, and an inorganic phosphate moiety.

In additional embodiments Z' is present and comprises one or more non-nucleotide moiety selected from an abasic moiety, an inverted abasic moiety, a hydrocarbon moiety such as $(CH_2)_3$, and an inorganic phosphate moiety.

In some embodiments each of Z and/or Z' comprises one or two non-nucleotide moieties and further comprises a nucleotide.

In some embodiments Z and/or Z' comprise abasic moieties, optionally deoxyribo-abasic (referred to herein as "dAb") or riboabasic (referred to herein as "rAb") moieties. In some embodiments each of Z and/or Z' is dAb-dAb or rAb-rAb.

In some embodiments Z and/or Z' comprise one or more hydrocarbon moieties, optionally $(CH_2)3$-Pi (referred to herein as "C3Pi"). In some embodiments Z and/or Z' is C3Pi-C3Ps; C3Pi-C3OH; or C3Pi-C3Pi.

In additional embodiments Z and/or Z' comprise a combination of abasic moieties and unmodified nucleotides or a combination of hydrocarbon modified moieties and unmodified nucleotides or a combination of abasic moieties and hydrocarbon modified moieties. In such embodiments, Z and/or Z' are optionally C3Pi-rAb. In a particular embodiment only Z is present and is C3Pi-C3Ps; C3Pi-C3OH; C3Pi-C3Pi.

In the embodiments of the above-mentioned Structures, the compound comprises at least one 3' overhang (Z and or Z') comprising at least one non-nucleotide moiety. Z and Z' independently comprises one non-nucleotide moiety and one or more covalently linked modified or non-modified nucleotides or unconventional moiety, for example inverted dT or dA; dT, LNA, mirror nucleotide and the like. The siRNA in which Z and/or Z' is present has improved activity and/or stability and/or off-target activity and or reduced immune response when compared to an siRNA in which Z and/or Z' are absent or in which Z and/or Z' is dTdT.

In certain embodiments for all the above-mentioned Structures, the compound comprises one or more phosphonocarboxylate and/or phosphinocarboxylate nucleotides (PACE nucleotides). In some embodiments the PACE nucleotides are deoxyribonucleotides and the phosphinocarboxylate nucleotides are phosphinoacetate nucleotides. Examples of PACE nucleotides and analogs are disclosed in U.S. Pat. Nos. 6,693,187 and 7,067,641, both incorporated herein by reference.

In certain embodiments for all the above-mentioned Structures, the compound comprises one or more locked nucleic acids (LNA) also defined as bridged nucleic acids or bicyclic nucleotides. Exemplary locked nucleic acids include 2'-O, 4'-C-ethylene nucleosides (ENA) or 2'-O, 4'-C-methylene nucleosides. Other examples of LNA and ENA nucleotides are disclosed in WO 98/39352, WO 00/47599 and WO 99/14226, all incorporated herein by reference.

In certain embodiments for all the above-mentioned Structures, the compound comprises one or more altritol monomers (nucleotides), also defined as 1,5 anhydro-2-deoxy-D-altrito-hexitol (see for example, Allart, et al., 1998. Nucleosides & Nucleotides 17:1523-1526; Herdewijn et al., 1999. Nucleosides & Nucleotides 18:1371-1376; Fisher et al., 2007, NAR 35(4):1064-1074; all incorporated herein by reference).

The present invention explicitly excludes double stranded compounds in which each of N and/or N' is a deoxyribonucleotide (dA, dC, dG, dT). In certain embodiments (N)x and (N')y may comprise independently 1, 2, 3, 4, 5, 6, 7, 8, 9 or 10 deoxyribonucleotides. In certain embodiments provided herein a compound wherein each of N is an unmodified ribonucleotide and the 3' terminal nucleotide or 2, 3, 4, 5, 6, 7, 8, 9, or 10, consecutive nucleotides at the 3' terminus of (N')y are deoxyribonucleotides. In further embodiments the 5' terminal nucleotide or 2, 3, 4, 5, 6, 7, 8, or 9 consecutive nucleotides at the 5' terminus and 1, 2, 3, 4, 5, or 6 consecutive nucleotides at the 3' termini of (N)x are deoxyribonucleotides and each of N' is an unmodified ribonucleotide. In yet further embodiments (N)x comprises unmodified ribonucleotides and 1 or 2, 3 or 4 consecutive deoxyribonucleotides independently at each of the 5' and 3' termini and 1 or 2, 3, 4, 5 or 6 consecutive deoxyribonucleotides in internal positions; and each of N' is an unmodified ribonucleotide. In some embodiments the 5' terminal nucleotide of N or 2 or 3 consecutive of N and 1, 2, or 3 of N' is a deoxyribonucleotide. Certain examples of active DNA/RNA siRNA chimeras are disclosed in US patent publication 2005/0004064, and Ui-Tei, 2008 (NAR 36(7):2136-2151) incorporated herein by reference in their entirety.

A covalent bond refers to an internucleotide linkage linking one nucleotide monomer to an adjacent nucleotide monomer. A covalent bond includes for example, a phosphodiester bond, a phosphorothioate bond, a P-alkoxy bond, a P-carboxy bond and the like. The normal internucleoside linkage of RNA and DNA is a 3' to 5' phosphodiester linkage. In certain embodiments a covalent bond is a phosphodiester bond. Covalent bond encompasses non-phosphorous-containing internucleoside linkages, such as those disclosed in WO 2004/041924 inter alia. Unless otherwise indicated, in embodiments of the structures discussed herein the covalent bond between each consecutive N or N' is a phosphodiester bond.

In some embodiments the oligonucleotide sequence of (N)x is fully complementary to the oligonucleotide sequence of (N')y. In other embodiments (N)x and (N')y are substantially complementary. In certain embodiments (N)x is fully complementary to a consecutive sequence in a target mRNA. In other embodiments (N)x is substantially complementary to consecutive sequence in a target mRNA.

DEFINITIONS

For convenience certain terms employed in the specification, examples and claims are described herein.

It is to be noted that, as used herein, the singular forms "a", "an" and "the" include plural forms unless the content clearly dictates otherwise.

An "inhibitor" is a compound, which is capable of reducing (partially or fully) the expression of a gene or the activity of the product of such gene to an extent sufficient to achieve a desired biological or physiological effect. The term "inhibitor" as used herein refers to a double stranded nucleic acid inhibitor.

A "dsRNA inhibitor" or dsNA inhibitor refers to a double stranded nucleic acid compound or molecule which is capable of reducing the expression of a gene or the activity of the product of such gene to an extent sufficient to achieve a desired biological or physiological effect. The term "siRNA inhibitor" as used herein refers to one or more of a siRNA, shRNA, synthetic shRNA; miRNA. As used herein, the term "inhibit", "down-regulate", or "reduce" with respect to gene expression means that the expression of a target gene, or level of RNA molecules or equivalent RNA molecules encoding one or more proteins or protein subunits (e.g., mRNA), or activity of one or more proteins or protein subunits, is reduced below that observed in the absence of an inhibitor (such as a nucleic acid molecule, e.g., a dsNA, for example having structural features as described herein); for example the expression may be reduced to 90%, 80%, 70%, 60%, 50%, 40%, 30%, 20%, 10%, 5% or less than that observed in the absence of an inhibitor.

As used herein, the term "inhibition" of a target gene means inhibition of the gene expression (transcription or translation) or polypeptide activity of a target gene wherein the target gene is mammalian gene selected from the group consisting of TLR2, TLR4, MYD88, TICAM1 and TIRAP, or variants thereof. The polynucleotide sequence of the target mRNA sequence, or the target gene having a mRNA sequence refer to the mRNA sequence or any homologous sequences thereof preferably having at least 70% identity, more preferably 80% identity, even more preferably 90% or 95% identity to the mRNA of TLR2, TLR4, MYD88, TICAM1 and TIRAP. Therefore, polynucleotide sequences derived from the mammalian gene selected from the group consisting of TLR2, TLR4, MYD88, TICAM1 and TIRAP RNA and mRNA which have undergone mutations, alterations or modifications as described herein are encompassed in the present invention. The terms "mRNA polynucleotide sequence", "mRNA sequence" and "mRNA" are used interchangeably.

As used herein, the terms "polynucleotide" and "nucleic acid" may be used interchangeably and refer to nucleotide sequences comprising deoxyribonucleic acid (DNA), and ribonucleic acid (RNA). The terms should also be understood to include, as equivalents, analogs of either RNA or DNA made from nucleotide analogs. Throughout this application mRNA sequences are set forth as representing the target of their corresponding genes. The terms "mRNA polynucleotide sequence" and mRNA are used interchangeably.

"Oligonucleotide" or "oligomer" refers to a deoxyribonucleotide or ribonucleotide sequence from about 2 to about 50 nucleotides. Each DNA or RNA nucleotide may be independently natural or synthetic, and or modified or unmodified. Modifications include changes to the sugar moiety, the base moiety and/or the linkages between nucleotides in the oligonucleotide. An oligonucleotide disclosed herein encompass molecules comprising deoxyribonucleotides, ribonucleotides, modified deoxyribonucleotides, modified ribonucleotides and combinations thereof. As used herein, the terms "non-pairing nucleotide analog" means a nucleotide analog which comprises a non-base pairing moiety including but not limited to: 6 des amino adenosine (Nebularine), 4-Me-indole, 3-nitropyrrole, 5-nitroindole, Ds, Pa, N3-Me ribo U, N3-Me riboT, N3-Me dC, N3-Me-dT, N1-Me-dG, N1-Me-dA, N3-ethyl-dC, N3-Me dC. In some embodiments the non-base pairing nucleotide analog is a ribonucleotide. In other embodiments it is a deoxyribonucleotide.

Provided herein are methods and compositions for inhibiting expression of a target gene in vivo. In general, the method includes administering oligoribonucleotides, such as double stranded RNAs, in particular small interfering RNAs (i.e., siRNAs) or a nucleic acid material that generates siRNA in a cell, to target a mammalian mRNA in an amount sufficient to down-regulate expression of a target gene by an RNA interference mechanism. In particular, the method is useful for inhibiting expression of the gene for treatment of a subject suffering from a disease related to expression of that gene. As disclosed herein the dsRNA molecules or inhibitors of the target gene are used as drugs to treat various pathologies.

"siRNA compound" and "nucleic acid molecule" may be used interchangeably herein.

"Nucleotide" is meant to encompass a compound consisting of a nucleoside (a sugar, usually ribose or deoxyribose, and a purine or pyrimidine base) and a phospho linker; such as a deoxyribonucleotide and a ribonucleotide, which may be natural or synthetic, and be modified or unmodified. Modifications include changes and substitutions to the sugar moiety, the base moiety and/or the internucleotide linkages.

A "phosphate based" moiety includes inorganic phosphate (Pi) and phosphorothioate (Ps).

All analogs of, or modifications to, a nucleotide/oligonucleotide may be employed with the molecules disclosed herein, provided that said analog or modification does not substantially adversely affect the function of the nucleotide/oligonucleotide. Acceptable modifications include modifications of the sugar moiety, modifications of the base moiety, modifications in the internucleotide linkages and combinations thereof.

What is sometimes referred to as an "abasic nucleotide" or "abasic nucleotide analog" is more properly referred to as a pseudo-nucleotide or an unconventional moiety. A nucleotide is a monomeric unit of nucleic acid, consisting of a ribose or deoxyribose sugar, a phosphate, and a base (adenine, guanine, thymine, or cytosine in DNA; adenine, guanine, uracil, or cytosine in RNA). A modified nucleotide comprises a modification in one or more of the sugar, phosphate and or base. The abasic pseudo-nucleotide lacks a base, and thus is not strictly a nucleotide. Abasic deoxyribose moiety includes for example abasic deoxyribose-3'-phosphate; 1,2-dideoxy-D-ribofuranose-3-phosphate; 1,4-anhydro-2-deoxy-D-ribitol-3-phosphate. Inverted abasic deoxyribose moiety includes inverted deoxyriboabasic; 3',5' inverted deoxyabasic 5'-phosphate. In general, an inverted abasic moiety is covalently attached to a 3' terminal nucleotide via a 3'-3' linkage; an inverted abasic moiety is covalently attached to a 5' terminal nucleotide via a 5'-5' linkage; an inverted abasic moiety is generally covalently attached to an inverted abasic moiety via a 5'-3' linkage.

The term "capping moiety" (z") as used herein includes a moiety which can be covalently linked to the 5' terminus of (N')y and includes abasic ribose moiety, abasic deoxyribose moiety, modified abasic ribose and abasic deoxyribose moieties including 2' O alkyl modifications; inverted abasic ribose and abasic deoxyribose moieties and modifications thereof; C6-imino-Pi; a mirror nucleotide including L-DNA and L-RNA; 5'OMe nucleotide; and nucleotide analogs including 4',5'-methylene nucleotide; 1-(β-D-erythrofuranosyl)nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 12-aminododecyl phosphate; hydroxypropyl phosphate; 1,5-anhydrohexitol nucleotide; alpha-nucleotide; threo-pentofuranosyl nucleotide; acyclic 3',4'-seco nucleotide; 3,4-dihydroxybutyl nucleotide; 3,5-dihydroxypentyl nucleotide, 5'-5'-inverted abasic moiety; 1,4-butanediol phosphate; 5'-amino; and bridging or non bridging methylphosphonate and 5'-mercapto moieties.

Certain capping moieties are abasic ribose or abasic deoxyribose moieties; inverted abasic ribose or inverted abasic deoxyribose moieties; C6-amino-Pi; a mirror nucleotide including L-DNA and L-RNA. The compounds disclosed herein may be synthesized using one or more inverted nucleotides, for example inverted thymidine or inverted adenine (for example see Takei, et al., 2002. JBC 277(26): 23800-06.

Chemical modifications also include unlocked nucleic acids, or UNAs, which are non-nucleotide, acyclic analogues, in which the C2'-C3' bond is not present (although UNAs are not truly nucleotides, they are expressly included in the scope of "modified" nucleotides or modified nucleic acids as contemplated herein). In particular embodiments, nucleic acid molecules with a overhang may be modified to have UNAs at the overhang positions (i.e., 2 nucleotide overhand). In other embodiments, UNAs are included at the 3'- or 5'-ends. A UNA may be located anywhere along a nucleic acid strand, i.e. at position 5, 6, 7, 8, or 9. Nucleic acid molecules may contain one or more than UNA. Exemplary UNAs are disclosed in Nucleic Acids Symposium Series No. 52 p. 133-134 (2008).

The term "non-nucleotide moiety" refers to a moiety that is not a nucleotide, i.e. does not include all of the components of a nucleotide: a sugar. a base and a linker.

The term "unconventional moiety" as used herein refers to the non-nucleotide moieties including an abasic moiety, an inverted abasic moiety, an alkyl moiety or alcohol, and an inorganic phosphate and further includes a deoxyribonucleotide, a modified deoxyribonucleotide, a mirror nucleotide (L-DNA or L-RNA), a non-base pairing nucleotide analog and a nucleotide joined to an adjacent nucleotide by a 2'-5' internucleotide phosphate bond (also known as 2'5' nucleotide); bridged nucleic acids including LNA and ethylene bridged nucleic acids, linkage modified (e.g. PACE) and base modified nucleotides as well as additional moieties explicitly disclosed herein as unconventional moieties.

When used in reference to the overhangs, an "alkyl moiety" or a "hydrocarbon moiety" refers to a C2, C3, C4, C5 or C6 straight chain or branched alkyl moiety, including for example C2 (ethyl), C3 (propyl). When used in reference to the overhangs, a "derivative" of an alkyl or a hydrocarbon moiety refers to a C2, C3, C4, C5 or C6 straight chain or branched alkyl moiety comprising a functional group which may be selected from among, inter alia, alcohols, phosphodiester, phosphorothioate, phosphonoacetate, amines, carboxylic acids, esters, amides and aldehydes.

When used in reference to modification of the ribose or deoxyribose moiety, "alkyl" is intended to include linear, branched, or cyclic saturated hydrocarbon structures and combinations thereof. "Lower alkyl", when used in reference to modification of the ribose or deoxyribose moiety, refers specifically to alkyl groups of from 1 to 6 carbon atoms. Examples of lower alkyl groups include methyl, ethyl, propyl, isopropyl, butyl, s- and t-butyl and the like. Preferred alkyl groups are those of $C_{20}$ or below. Cycloalkyl is a subset of alkyl and includes cyclic saturated hydrocarbon groups of from 3 to 8 carbon atoms. Examples of cycloalkyl groups include c-propyl, c-butyl, c-pentyl, norbornyl, adamantyl and the like "Terminal functional group" includes halogen, alcohol, amine, carboxylic, ester, amide, aldehyde, ketone, ether groups.

As used herein, a "mirror" nucleotide (also referred to as a spiegelmer) is a nucleotide analog with reverse chirality to the naturally occurring or commonly employed nucleotide, i.e., a mirror image of the naturally occurring or commonly employed nucleotide. The mirror nucleotide is a ribonucleotide (L-RNA) or a deoxyribonucleotide (L-DNA) and may further comprise at least one sugar or base modification and/or a backbone modification, such as a phosphorothioate or phosphonate moiety. U.S. Pat. No. 6,602,858 discloses nucleic acid catalysts comprising at least one L-nucleotide substitution. Mirror nucleotide includes for example L-DNA (L-deoxyriboadenosine-3'-phosphate (mirror dA); L-deoxyribocytidine-3'-phosphate (mirror dC); L-deoxyriboguanosine-3'-phosphate (mirror dG); L-deoxyribothymidine-3'-phosphate (mirror image dT)) and L-RNA (L-riboadenosine-3'-phosphate (mirror rA); L-ribocytidine-3'-phosphate (mirror rC); L-riboguanosine-3'-phosphate (mirror rG); L-ribouracil-3'-phosphate (mirror dU).

Modified deoxyribonucleotide includes, for example 5'OMe DNA (5-methyl-deoxyriboguanosine-3'-phosphate) which may be useful as a nucleotide in the 5' terminal position (position number 1); PACE (deoxyriboadenine 3' phosphonoacetate, deoxyribocytidine 3' phosphonoacetate, deoxyriboguanosine 3' phosphonoacetate, deoxyribothymidine 3' phosphonoacetate.

Unconventional moieties include bridged nucleic acids including LNA (2'-O,4'-C-methylene bridged Nucleic Acid adenosine 3' monophosphate, 2'-O,4'-C-methylene bridged Nucleic Acid 5-methyl-cytidine 3' monophosphate, 2'-O,4'-C-methylene bridged Nucleic Acid guanosine 3' monophosphate, 5-methyl-uridine (or thymidine) 3' monophosphate); and ENA (2'-O,4'-C-ethylene bridged Nucleic Acid adenosine 3' monophosphate, 2'-O,4'-C-ethylene bridged Nucleic Acid 5-methyl-cytidine 3' monophosphate, 2'-O,4'-C-ethylene bridged Nucleic Acid guanosine 3' monophosphate, 5-methyl-uridine (or thymidine) 3' monophosphate).

In some embodiments the unconventional moiety is an abasic ribose moiety, an abasic deoxyribose moiety, a deoxyribonucleotide, a mirror nucleotide, and a nucleotide joined to an adjacent nucleotide by a 2'-5' internucleotide phosphate bond.

The nucleotides are selected from naturally occurring or synthetic modified bases. Naturally occurring bases include adenine, guanine, cytosine, thymine and uracil. Modified bases of nucleotides include inosine, xanthine, hypoxanthine, 2-aminoadenine, 6-methyl, 2-propyl and other alkyl adenines, 5-halo uracil, 5-halo cytosine, 6-aza cytosine and 6-aza thymine, pseudo uracil, 4-thiouracil, 8-halo adenine, 8-aminoadenine, 8-thiol adenine, 8-thiolalkyl adenines, 8-hydroxyl adenine and other 8-substituted adenines, 8-halo guanines, 8-amino guanine, 8-thiol guanine, 8-thioalkyl guanines, 8-hydroxyl guanine and other substituted guanines, other aza and deaza adenines, other aza and deaza guanines, 5-trifluoromethyl uracil and 5-trifluoro cytosine. dsRNA compounds comprising one or more abasic pseudonucleotides are encompassed herein. A nucleotide monomer comprising a modified base, including abasic pseudonucleotide monomers, may be substituted for one or more ribonucleotides of the oligonucleotide. An abasic pseudonucleotide monomer may be included at the one or more of the terminal positions or as a 5' terminal cap. A 5' terminal cap may also be selected from an inverted abasic pseudonucleotide analog, an L-DNA nucleotide, and a C6-imine phosphate.

In addition, analogues of polynucleotides are prepared wherein the structure of one or more nucleotide is fundamentally altered and better suited as therapeutic or experimental reagents. An example of a nucleotide analog is a peptide nucleic acid (PNA) wherein the deoxyribose (or ribose) phosphate backbone in DNA (or RNA) comprises a polyamide backbone which is similar to that found in peptides. PNA analogs have been shown to be resistant to enzymatic degradation and to have extended lives in vivo and in vitro.

Possible modifications to the sugar residue are manifold and include 2'-O alkyl, 2'-halo (e.g. 2' deoxy fluoro), locked nucleic acid (LNA), glycol nucleic acid (GNA), threose nucleic acid (TNA), arabinoside; altritol (ANA) and other 6-membered sugars including morpholinos, and cyclohexinyls. Possible modifications on the 2' moiety of the sugar residue include amino, fluoro, methoxy alkoxy, alkyl, amino, fluoro, chloro, bromo, CN, CF, imidazole, carboxylate, thioate, $C_1$ to $C_{10}$ lower alkyl, substituted lower alkyl, alkaryl or aralkyl, $OCF_3$, OCN, O-, S-, or N-alkyl; O-, S, or N-alkenyl; $SOCH_3$; $SO_2CH_3$; $ONO_2$; $NO_2$, $N_3$; heterozycloalkyl; heterozycloalkaryl; aminoalkylamino; polyalkylamino or substituted silyl, as, among others, described in European patents EP 0 586 520 B1 or EP 0 618 925 B1. One or more deoxyribonucleotides are also tolerated in the compounds disclosed herein. In some embodiments (N') comprises 1, 2, 3, 4, 5, 6, 7, 8, 9 or 10 DNA moieties.

LNA compounds are disclosed in International Patent Publication Nos. WO 00/47599, WO 99/14226, and WO 98/39352. Examples of siRNA compounds comprising LNA nucleotides are disclosed in Elmen et al., (NAR 2005. 33(1):439-447) and in International Patent Publication No. WO 2004/083430. Six-membered ring nucleotide analogs are disclosed in Allart, et al (Nucleosides & Nucleotides, 1998, 17:1523-1526; and Perez-Perez, et al., 1996, Bioorg. and Medicinal Chem Letters 6:1457-1460) Oligonucleotides comprising 6-membered ring nucleotide analogs including hexitol and altritol nucleotide monomers are disclosed in International patent application publication No. WO 2006/047842.

Backbone modifications, also known as internucleotide linkage modifications, such as ethyl (resulting in a phospho-ethyl triester); propyl (resulting in a phospho-propyl triester); and butyl (resulting in a phospho-butyl triester) are also possible. Other backbone modifications include polymer backbones, cyclic backbones, acyclic backbones, thiophosphate-D-ribose backbones, amidates, phosphonoacetate derivatives. Certain structures include dsRNA compounds having one or a plurality of 2'-5' internucleotide linkages (bridges or backbone).

In some embodiments, neither (N)x nor (N')y are phosphorylated at the 3' and 5' termini. In other embodiments either or both (N)x and (N')y are phosphorylated at the 3' termini (3' Pi). In yet another embodiment, either or both (N)x and (N')y are phosphorylated at the 3' termini with non-cleavable phosphate groups. In yet another embodiment, either or both (N)x and (N')y are phosphorylated at the terminal 2' termini position using cleavable or non-cleavable phosphate groups. Further, the inhibitory nucleic acid molecules disclosed herein may comprise one or more gaps and/or one or more nicks and/or one or more mismatches. Without wishing to be bound by theory, gaps, nicks and mismatches have the advantage of partially destabilizing the nucleic acid/siRNA, so that it may be more easily processed by endogenous cellular machinery such as DICER, DROSHA or RISC into its inhibitory components.

As used herein, a gap in a nucleic acid refers to the absence of one or more internal nucleotides in one strand, while a nick in a nucleic acid refers to the absence of an internucleotide linkage between two adjacent nucleotides in one strand. Any of the molecules disclosed herein may contain one or more gaps and/or one or more nicks.

Nucleic acid molecules include those with blunt ends, i.e., ends that do not include any overhanging nucleotides. A nucleic acid molecule can include one or more blunt ends. The blunt ended nucleic acid molecule has a number of base pairs equal to the number of nucleotides present in each strand of the nucleic acid molecule. The nucleic acid molecule can include one blunt end, for example where the 5'-end of the antisense strand and the 3'-end of the sense strand do not have any overhanging nucleotides. Nucleic acid molecule may include one blunt end, for example where the 3'-end of the antisense strand and the 5'-end of the sense strand do not have any overhanging nucleotides. A nucleic acid molecule may include two blunt ends, for example where the 3'-end of the antisense strand and the 5'-end of the sense strand as well as the 5'-end of the antisense strand and 3'-end of the sense strand do not have any overhanging nucleotides. Other nucleotides present in a blunt ended nucleic acid molecule can include, for example, mismatches, bulges, loops, or wobble base pairs to modulate the activity of the nucleic acid molecule, e.g. to mediate RNA interference.

In certain embodiments of the nucleic acid molecules (e.g., dsNA molecules) provided herein, at least one end of the molecule has an overhang of at least one nucleotide (for example 1 to 8 nucleotides covalently attached to a terminus of the oligonucleotide). For example, one or both strands of a double stranded nucleic acid molecule disclosed herein may have an overhang at the 5'-end or at the 3'-end or both. An overhang may be present at either or both the sense strand and antisense strand of the nucleic acid molecule. The length of the overhang may be as little as one nucleotide and as long as 1 to 8 or more nucleotides (e.g., 1, 2, 3, 4, 5, 6, 7 or 8 nucleotides; in some preferred embodiments an overhang is 2, 3, 4, 5, 6, 7 or 8 nucleotides; for example an overhang may be 2 nucleotides. The nucleotide(s) forming the overhang may be include deoxyribonucleotide(s), ribonucleotide(s), natural and non-natural nucleobases or any nucleotide modified in the sugar, base or phosphate group, such as disclosed herein. A double stranded nucleic acid molecule may have both 5'- and 3'-overhangs. The overhangs at the 5'- and 3'-end may be of different lengths. A overhang may include at least one nucleic acid modification which may be deoxyribonucleotide. One or more deoxyribonucleotides may be at the 5'-terminus. The 3'-end of the respective counter-strand of the nucleic acid molecule may not have an overhang, more preferably not a deoxyribonucleotide overhang. The one or more deoxyribonucleotide may be at the 3'-terminus. The 5'-end of the respective counter-strand of the dsRNA may not have an overhang, more preferably not a deoxyribonucleotide overhang. The overhang in either the 5'- or the 3'-end of a strand may be 1 to 8 (e.g., about 1, 2, 3, 4, 5, 6, 7 or 8) unpaired nucleotides, preferably, the overhang is 2-3 unpaired nucleotides; more preferably 2 unpaired nucleotides. Nucleic acid molecules may include duplex nucleic acid molecules with overhanging ends of about 1 to about 20 (e.g., about 1, 2, 3, 4, 5, 6, 7, 8, 9, 10, 11, 12, 13, 1, 15, 16, 17, 18, 19 or 20); preferably 1-8 (e.g., about 1, 2, 3, 4, 5, 6, 7 or 8) nucleotides, for example, about 21-nucleotide duplexes with about 19 base pairs and 3'-terminal mononucleotide, dinucleotide, or trinucleotide overhangs. Nucleic acid molecules provided herein may include duplex nucleic acid molecules with blunt ends, where both ends are blunt, or alternatively, where one of the ends is blunt. Nucleic acid molecules disclosed herein can include one or more blunt ends, i.e. where a blunt end does not have any overhanging nucleotides. In one embodiment, the blunt ended nucleic acid molecule has a number of base pairs equal to the number of nucleotides present in each strand of the nucleic acid molecule. The nucleic acid molecule may include one blunt end, for example where the 5'-end of the antisense strand and the 3'-end of the sense strand do not have any overhanging nucleotides. The nucleic acid molecule may include one blunt end, for example where the 3'-end of the antisense strand and the 5'-end of the sense strand do not have any overhanging nucleotides. A nucleic acid molecule may include two blunt ends, for example where the 3'-end of the antisense strand and the 5'-end of the sense strand as well as the 5'-end of the antisense strand and 3'-end of the sense strand do not have any overhanging nucleotides. In certain preferred embodiments the nucleic acid compounds are blunt ended. Other nucleotides present in a blunt ended dsNA molecule can include, for example, mismatches, bulges, loops, or wobble base pairs to modulate the activity of the nucleic acid molecule to mediate RNA interference.

In many embodiments one or more, or all, of the overhang nucleotides of a nucleic acid molecule (e.g., a dsNA molecule) as described herein includes are modified such as described herein; for example one or more, or all, of the nucleotides may be 2'-deoxynucleotides.

Amount, Location and Patterns of Modifications of Nucleic Acid Compounds

[Nucleic acid molecules (e.g., dsNA molecules) disclosed herein may include modified nucleotides as a percentage of the total number of nucleotides present in the nucleic acid molecule. As such, a nucleic acid molecule may include about 5% to about 100% modified nucleotides (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides). The actual percentage of modified nucleotides present in a given nucleic acid molecule will depend on the total number of nucleotides present in the nucleic acid. If the nucleic acid molecule is single stranded, the percent modification can be based upon the total number of nucleotides present in the single stranded nucleic acid molecule. Likewise, if the nucleic acid molecule is double stranded, the percent modification can be based upon the total number of nucleotides present in the sense strand, antisense strand, or both the sense and antisense strands.

[Nucleic acid molecules disclosed herein may include unmodified RNA as a percentage of the total nucleotides in the nucleic acid molecule. As such, a nucleic acid molecule may include about 5% to about 100% unmodified nucleotides (e.g., about 5%, 10%, 15%, 20%, 25%, 30%, 35%, 40%, 45%, 50%, 55%, 60%, 65%, 70%, 75%, 80%, 85%, 90%, 95% or 100% of total nucleotides present in a nucleic acid molecule).

A nucleic acid molecule (e.g., an dsNA molecule) may include a sense strand that includes about 1 to about 5, specifically about 1, 2, 3, 4, or 5 phosphorothioate internucleotide linkages, and/or one or more (e.g., about 1, 2, 3, 4, 5, or more) 2'-deoxy, 2'-O-methyl, 2'-deoxy-2'-fluoro, and/or one or more (e.g., about 1, 2, 3, 4, 5, or more) universal base modified nucleotides, and optionally a terminal cap molecule at the 3-end, the 5'-end, or both of the 3'- and 5'-ends of the sense strand; and wherein the antisense strand includes about 1 to about 5 or more, specifically about 1, 2, 3, 4, 5, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. A nucleic acid molecule may include about 1, 2, 3, 4, 5, 6, 7, 8, 9, 10, or more, pyrimidine nucleotides of the sense and/or antisense nucleic acid strand are chemically-modified with 2'-deoxy, 2'-O-methyl and/or 2'-deoxy-2'-fluoro nucleotides, with or without about 1 to about 5 or more, for example about 1, 2, 3, 4, 5, or more phosphorothioate internucleotide linkages and/or a terminal cap molecule at the 3'-end, the 5'-end, or both of the 3'- and 5'-ends, being present in the same or different strand.

A nucleic acid molecule may include about 1 to about 5 or more (specifically about 1, 2, 3, 4, 5 or more) phosphorothioate internucleotide linkages in each strand of the nucleic acid molecule.

A nucleic acid molecule may include 2'-5' internucleotide linkages, for example at the 3'-end, the 5'-end, or both of the 3'-end and 5'-end of one or both nucleic acid sequence strands. In addition, the 2'-5' internucleotide linkage(s) can be present at various other positions within one or both nucleic acid sequence strands, for example, about 1, 2, 3, 4, 5, 6, 7, 8, 9, 10, or more including every internucleotide linkage of a pyrimidine nucleotide in one or both strands of the siNA molecule can include a 2'-5' internucleotide linkage, or about 1, 2, 3, 4, 5, 6, 7, 8, 9, 10, or more including every internucleotide linkage of a purine nucleotide in one or both strands of the siNA molecule can include a 2'-5' internucleotide linkage.

A chemically-modified short interfering nucleic acid (dsNA) molecule may include an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-deoxy purine nucleotides (e.g., wherein all purine nucleotides are 2'-deoxy purine nucleotides or alternately a plurality of purine nucleotides are 2'-deoxy purine nucleotides).

A chemically-modified short interfering nucleic acid (dsNA) molecule may include an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides).

A chemically-modified short interfering nucleic acid (dsNA) molecule capable of mediating RNA interference (RNAi) against TLR2 and/or TLR4 inside a cell or reconstituted in vitro system may include a sense region, wherein one or more pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and one or more purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), and an antisense region, wherein one or more pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and one or more purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). The sense region and/or the antisense region can have a terminal cap modification, such as any modification, that is optionally present at the 3'-end, the 5'-end, or both of the 3'-end and the 5'-end of the sense and/or antisense sequence. The sense and/or antisense region can optionally further include a 3'-terminal nucleotide overhang having about 1 to about 4 (e.g., about 1, 2, 3, or 4) 2'-deoxyribonucleotides. The overhang nucleotides can further include one or more (e.g., about 1, 2, 3, 4 or more) phosphorothioate, phosphonoacetate, and/or thiophosphonoacetate internucleotide linkages. The purine nucleotides in the sense region may alternatively be 2'-O-methyl purine nucleotides (e.g., wherein all purine nucleotides are 2'-O-methyl purine nucleotides or alternately a plurality of purine nucleotides are 2'-O-methyl purine nucleotides) and one or more purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). One or more purine nucleotides in the sense region may alternatively be purine ribonucleotides (e.g., wherein all purine nucleotides are purine ribonucleotides or alternately a plurality of purine nucleotides are purine ribonucleotides) and any purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). One or more purine nucleotides in the sense region and/or present in the antisense region may alternatively be selected from the group consisting of 2'-deoxy nucleotides, locked nucleic acid (LNA) nucleotides, 2'-methoxyethyl nucleotides, 4'-thionucleotides, and 2'-O-methyl nucleotides (e.g., wherein all purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides or alternately a plurality of purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides).

Double Stranded Oligonucleotides

The selection and synthesis of dsRNAs, such as siRNA corresponding to known genes has been widely reported; see for example Ui-Tei et al., J Biomed Biotechnol. 2006; 65052; Chalk et al., BBRC. 2004, 319(1):264-74; Sioud & Leirdal, Met. Mol. Biol. 2004, 252:457-69; Levenkova et al., Bioinform. 2004, 20(3):430-2; Ui-Tei et al., NAR. 2004, 32(3):936-48. For examples of the use and production of modified dsRNA see for example Braasch et al., Biochem. 2003, 42(26):7967-75; Chiu et al., RNA. 2003, 9(9):1034-48; PCT Publication Nos. WO 2004/015107 and WO 02/44321 and U.S. Pat. Nos. 5,898,031 and 6,107,094.

Provided herein are double-stranded oligonucleotides (e.g. dsRNAs, including siRNAs), which down-regulate the expression of a desired gene. The dsRNA disclosed herein are duplex oligoribonucleotides in which the sense strand is derived from the mRNA sequence of the desired gene, and the antisense strand is at least substantially complementary to the sense strand. In general, some deviation from the target mRNA sequence is tolerated without compromising the siRNA activity (see e.g. Czauderna et al., NAR. 2003, 31(11):2705-2716). The dsRNA disclosed herein inhibit gene expression on a post-transcriptional level with or without destroying the mRNA. Without being bound by theory, dsRNA may be siRNA which targets the mRNA for specific cleavage and degradation and/or may inhibit translation from the targeted message.

In other embodiments at least one of the two strands may have an overhang of at least one nucleotide at the 5'-terminus; the overhang may consist of at least one deoxyribonucleotide. The length of RNA duplex is from about 16 to about 40 ribonucleotides, preferably 19 ribonucleotides. Further, the length of each strand may independently have a length selected from the group consisting of about 16 to about 40 bases, preferably 18 to 23 bases and more preferably 19 ribonucleotides.

In certain embodiments the complementarity between said first strand and the target nucleic acid is perfect. In some embodiments, the strands are substantially complementary, i.e. having one, two or up to five mismatches between said first strand and the target mRNA or between the first and the second strands. Substantially complementary refers to complementarity of greater than about 70%, and less than 100% to another sequence. For example in a duplex region consisting of 19 base pairs one mismatch results in 94.7% complementarity, two mismatches results in about 89.5% complementarity, 3 mismatches results in about 84.2% complementarity, 4 mismatches results in about 79% complementarity and 5 mismatches results in about 74% complementarity, rendering the duplex region substantially complementary. Accordingly, substantially identical refers to identity of greater than about 70%, to another sequence.

The first strand and the second strand may be linked by a loop structure, which may be comprised of a non-nucleic acid polymer such as, inter alia, polyethylene glycol. Alternatively, the loop structure may be comprised of a nucleic acid, including modified and non-modified ribonucleotides and modified and non-modified deoxyribonucleotides.

Further, the 5'-terminus of the first strand of the dsRNA may be linked to the 3'-terminus of the second strand, or the 3'-terminus of the first strand may be linked to the 5'-terminus of the second strand, said linkage being via a nucleic acid linker typically having a length between 2-100 nucleobases, preferably about 2 to about 30 nucleobases.

In some embodiments, the compounds include alternating ribonucleotides modified in at least one of the antisense and the sense strands of the compound, for 19 mer and 23 mer oligomers the ribonucleotides at the 5' and 3' termini of the antisense strand are modified in their sugar residues, and the ribonucleotides at the 5' and 3' termini of the sense strand are unmodified in their sugar residues. For 21 mer oligomers the ribonucleotides at the 5' and 3' termini of the sense strand are modified in their sugar residues, and the ribonucleotides at the 5' and 3' termini of the antisense strand are unmodified in their sugar residues, or may have an optional additional modification at the 3' terminus. As mentioned above, in some embodiments the middle nucleotide of the antisense strand is unmodified.

According to one embodiment, the antisense and the sense strands of the oligonucleotide/siRNA are phosphorylated only at the 3'-terminus and not at the 5'-terminus. According to another embodiment, the antisense and the sense strands are non-phosphorylated. According to yet another embodiment, the 5' most ribonucleotide in the sense strand is modified to abolish any possibility of in vivo 5'-phosphorylation.

The dsRNA sequences disclosed herein are prepared having any of the modifications/structures disclosed herein. The combination of sequence plus structure is novel and is useful used in the treatment of the conditions disclosed herein.

"Target" or "Target gene" refers to the TLR2, TLR4, MYD88, TICAM1 and TIRAP RNA and mRNA polynucleotide sequences set forth in SEQ ID NO: 1-12, or any homologous sequence thereof preferably having at least 70% identity, more preferable 80% identity, even more preferably 90% or 95% identity. This encompasses any sequences derived from SEQ ID NO: 1-12 which have undergone mutations, alterations, polymorphisms or modifications as described herein.

Provided herein are novel unmodified and chemically modified oligonucleotides and oligoribonucleotide compounds that possess therapeutic properties. In particular, provided herein are chemically modified dsRNA compounds. The dsRNAs disclosed herein possess novel structures and novel modifications which have one or more of the following advantages: increased activity or reduced toxicity or reduced off-target effect or reduced immune response or increased stability; the novel modifications of the dsRNAs are beneficially applied to double stranded RNA useful in down regulating, inhibiting or attenuating TLR2, TLR4, MYD88, TICAM1 and TIRAP gene expression and to the use of the novel siRNAs in the treatment of various medical conditions. Particular conditions to be treated include, without being limited to, preventing, treating and attenuating posttransplantational complication in organ transplant, for example lung transplant patients, such as for example primary graft failure, ischemia-reperfusion injury, reperfusion injury, reperfusion edema, allograft dysfunction, pulmonary reimplantation response and/or primary graft dysfunction (PGD).

The compounds disclosed herein possess structures and modifications which impart one or more of increased activity, increased stability, reduced toxicity, reduced off target effect, and/or reduced immune response. The double stranded structures disclosed herein are beneficially applied to double stranded RNA useful in preventing or attenuating expression of TLR2, TLR4, MYD88, TICAM1 and TIRAP gene.

Also disclosed herein is the use of the chemically modified dsRNAs in preventing, treating and/or attenuating posttransplantational complication in organ transplant, such as lung transplant, patients, such as for example primary graft failure, ischemia-reperfusion injury, reperfusion injury, reperfusion edema, allograft dysfunction, pulmonary reimplantation response and/or primary graft dysfunction (PGD). Sense and antisense oligonucleotides useful in the synthesis of dsRNA as disclosed herein are provided in SEQ ID NOS:13-5846 (targeting TLR2), SEQ ID NOS:5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP).

SEQ ID NOS:13-3060 provide oligonucleotides useful in generating dsRNA compounds according to Structure (A1) to target TLR2; SEQ ID NOS:3061-5846 provide oligonucleotides useful in generating dsRNA compounds according to Structure (A2) to target TLR2. Certain preferred oligonucleotide pairs useful in generating double stranded nucleic acid molecules for down-regulating expression of TLR2 are set forth in Table 1, hereinbelow.

SEQ ID NOS:5847-8612 provide oligonucleotides useful in generating dsRNA compounds according to Structure (A1) to target TLR4; SEQ ID NOS:8613-12144 provide oligonucleotides useful in generating dsRNA compounds according to Structure (A2) to target TLR4.

SEQ ID NOS:12145-13924 provide oligonucleotides useful in generating dsRNA compounds according to Structure (A1) to target MYD88; SEQ ID NOS:13925-16332 provide oligonucleotides useful in generating dsRNA compounds according to Structure (A2) to target MYD88. A preferred oligonucleotide pair useful in generating double stranded nucleic acid molecule for down-regulating expression of MYD88 is set forth in Table 3, hereinbelow.

SEQ ID NOS:16333-16882 provide oligonucleotides useful in generating dsRNA compounds according to Structure (A1) to target TICAM1; SEQ ID NOS:16333-18242 provide oligonucleotides useful in generating dsRNA compounds according to Structure (A2) to target TICAM1. Certain preferred oligonucleotide pairs useful in generating double stranded nucleic acid molecules for down-regulating expression of TICAM1 are set forth in Table 4, hereinbelow.

SEQ ID NOS:18243-19010 provide oligonucleotides useful in generating dsRNA compounds according to Structure (A1) to target TIRAP; SEQ ID NOS:19011-20606 provide oligonucleotides useful in generating dsRNA compounds according to Structure (A2) to target TIRAP. Certain preferred oligonucleotide pairs useful in generating double stranded nucleic acid molecules for down-regulating expression of TIRAP are set forth in Table 5, hereinbelow.

Additional 21- or 23-mer dsRNA sequences are generated by 5' and/or 3' extension of the 19-mer oligonucleotide sequences disclosed herein. Such extension is preferably complementary to the corresponding mRNA sequence.

Methods, molecules and compositions disclosed herein which inhibit the TLR2, TLR4, MYD88, TICAM1 and TIRAP gene are discussed herein at length, and any of said molecules and/or compositions are beneficially employed in the treatment of a subject suffering from one or more of said conditions.

Throughout the specification, nucleotide positions are numbered from 1 to 19 and are counted from the 5' end of the antisense strand or the sense strand. For example, position 1 on (N)x refers to the 5' terminal nucleotide on the antisense oligonucleotide strand and position 1 on (N')y refers to the 5' terminal nucleotide on the sense oligonucleotide strand. In the double stranded nucleic acid molecules according to Structure A2, N1 represents position 1 (5' terminal nucleotide) in the antisense strand and N2 represents the 3' terminal nucleotide in the sense strand.

An additional molecule disclosed herein is an oligonucleotide comprising consecutive nucleotides wherein a first segment of such nucleotides encode a first inhibitory RNA molecule, a second segment of such nucleotides encode a second inhibitory RNA molecule, and a third segment of such nucleotides encode a third inhibitory RNA molecule. Each of the first, the second and the third segment may comprise one strand of a double stranded RNA and the first, second and third segments may be joined together by a linker. Further, the oligonucleotide may comprise three double stranded segments joined together by one or more linker.

Thus, one molecule disclosed herein is an oligonucleotide comprising consecutive nucleotides which encode three inhibitory RNA molecules; said oligonucleotide may possess a triple stranded structure, such that three double stranded arms are linked together by one or more linker, such as any of the linkers presented hereinabove. This molecule forms a "star"-like structure, and may also be referred to herein as RNAstar. Such structures are disclosed in PCT patent publication WO 2007/091269, assigned to the assignee of the present invention and incorporated herein in its entirety by reference.

Said triple-stranded oligonucleotide may be an oligoribonucleotide having the general structure:

| 5' Oligo1 (sense) | LINKER A | Oligo2 (sense) | 3' |
| 3' Oligo1 (antisense) | LINKER B | Oligo3 (sense) | 5' |
| 3' Oligo3 (antisense) | LINKER C | Oligo2 (antisense) | 5' |
| Or | | | |
| 5' Oligo1 (sense) | LINKER A | Oligo2 (antisense) | 3' |
| 3' Oligo1 (antisense) | LINKER B | Oligo3 (sense) | 5' |
| 3' Oligo3 (antisense) | LINKER C | Oligo2 (sense) | 5' |
| or | | | |
| 5' Oligo1 (sense) | LINKER A | Oligo3 (antisense) | 3' |
| 3' Oligo1 (antisense) | LINKER B | Oligo2 (sense) | 5' |
| 5' Oligo3 (sense) | LINKER C | Oligo2 (antisense) | 3' | wherein one or more of linker A, linker B or linker C is present; any combination of two or more oligonucleotides and one or more of linkers A-C is possible, so long as the polarity of the strands and the general structure of the molecule remains. Further, if two or more of linkers A-C are present, they may be identical or different.

Thus, a triple-armed structure is formed, wherein each arm comprises a sense strand and complementary antisense strand (i.e. Oligo1 antisense base pairs to Oligo1 sense etc.). The triple armed structure may be triple stranded, whereby each arm possesses base pairing.

Further, the above triple stranded structure may have a gap instead of a linker in one or more of the strands. Such a molecule with one gap is technically quadruple stranded and not triple stranded; inserting additional gaps or nicks will lead to the molecule having additional strands. Preliminary results obtained by the inventors of the present invention indicate that said gapped molecules are more active in inhibiting the TLR2, TLR4, MYD88, TICAM1 and TIRAP target gene than the similar but non-gapped molecules.

In some embodiments, neither antisense nor sense strands of the novel dsRNA compounds disclosed herein are phosphorylated at the 3' and 5' termini. In other embodiments either or both the sense and the antisense strands are phosphorylated at the 3' termini. In yet another embodiment, either or both the sense and the antisense strands are phosphorylated at the 3' termini using non-cleavable phosphate groups. In yet another embodiment, either or both the sense and the antisense strands are phosphorylated at the terminal 5' termini position using cleavable or non-cleavable phosphate groups. In yet another embodiment, either or both the sense and the antisense strands are phosphorylated at the terminal 2' termini position using cleavable or non-cleavable phosphate groups. In some embodiments the dsRNA compounds are blunt ended and are non-phosphorylated at the termini; however, comparative experiments have shown that dsRNA compounds phosphorylated at one or both of the 3'-termini have similar activity in vivo compared to the non-phosphorylated compounds.

Any dsRNA sequence disclosed herein can be prepared having any of the modifications/Structures disclosed herein. The combination of sequence plus structure is novel and can be used in the treatment of the conditions disclosed herein.

Unless otherwise indicated, in preferred embodiments of the structures discussed herein the covalent bond between each consecutive N and N' is a phosphodiester bond.

For all of the structures above, in some embodiments the oligonucleotide sequence of antisense strand is fully complementary to the oligonucleotide sequence of sense. In other embodiments the sense and the antisense strands are substantially complementary. In certain embodiments the antisense strand is fully complementary to about 18 to about 40 consecutive ribonucleotides a target mRNA set forth in any one of SEQ ID NOS:1-12.

In other embodiments the antisense strand is substantially complementary to about 18 to about 40 consecutive ribonucleotides a target mRNA set forth in any one of SEQ ID NOS:1-12.

In some embodiments, disclosed herein is an expression vector comprising an antisense oligonucleotide disclosed in any one of SEQ ID NOS: 13-20606. In some embodiments the expression vector further comprises a sense oligonucleotide having complementarity to the antisense oligonucleotide. In various embodiments are further provided a cell comprising an expression vector comprising a sense and an antisense oligonucleotide disclosed in any one of SEQ ID NOS: 13-20606 or 20602-20684. Further disclosed herein is a siRNA expressed in a cell comprising an expression vector comprising a sense and an antisense oligonucleotide disclosed in any one of SEQ ID NOS: 13-20606, or 20602-20684, a pharmaceutical composition comprising same and use thereof for treatment of any one of the disorders disclosed herein.

In other embodiments, disclosed herein is a first expression vector comprising an antisense oligonucleotide disclosed in any one of SEQ ID NOS: 13-20606 and a second expression vector comprising a sense oligonucleotide having complementarity to the antisense oligonucleotide comprised in the first expression vector. In various embodiments disclosed herein is a cell comprising a first expression vector comprising an antisense oligonucleotide disclosed in any one of SEQ ID NOS: 13-20606 and a second expression vector comprising a sense oligonucleotide having complementarity to the antisense oligonucleotide comprised in the first expression vector. Further disclosed herein is a dsRNA expressed in a cell comprising such first and second expression vector, a pharmaceutical composition comprising same and use thereof for treatment of any one of the diseases and disorders disclosed herein.

RNA Interference

RNA interference (RNAi) is a phenomenon involving double-stranded (ds) RNA-dependent gene specific post-transcriptional silencing. RNAi refers to the process of sequence-specific post-transcriptional gene silencing in mammals mediated by small interfering RNAs (siRNAs) (Fire et al, Nature 1998. 391, 806) or microRNAs (miRNA; Ambros, Nature 2004 431:7006, 350-55; and Bartel, Cell. 2004. 116(2):281-97). RNAi has been described in numerous publications, including Gil et al. Apoptosis, 2000. 5:107-114, Elbashir et al. Nature 2001, 411:494-498 and Caplen et al. PNAS USA 2001, 98:9742-9747. A siRNA is a double-stranded RNA molecule which inhibits, either partially or fully, the expression of a gene/mRNA of its endogenous or cellular counterpart, or of an exogenous gene such as a viral nucleic acid. The mechanism of RNA interference is detailed infra.

Studies have revealed that siRNA is effective in vivo in mammals, including humans. For reviews of therapeutic applications of siRNAs see for example Batik (Mol. Med. 2005, 83: 764-773), Chakraborty (Current Drug Targets 2007 8(3):469-82); Durcan (Mol. Pharma. 2008. 5(4):559-566); Kim and Rossi (BioTechniques 2008. 44:613-616); Grimm and Kay, (JCI, 2007. 117(12):3633-41).

A number of PCT applications have been published that relate to the RNAi phenomenon. These include: PCT publication WO 00/44895; PCT publication WO 00/49035; PCT publication WO 00/63364; PCT publication WO 01/36641; PCT publication WO 01/36646; PCT publication WO 99/32619; PCT publication WO 00/44914; PCT publication WO 01/29058; and PCT publication WO 01/75164.

RNA interference (RNAi) is based on the ability of dsRNA species to enter a cytoplasmic protein complex, where it is then targeted to the complementary cellular RNA and specifically degrade it. The RNA interference response features an endonuclease complex containing a dsRNA, commonly referred to as an RNA-induced silencing complex (RISC), which mediates cleavage of single-stranded RNA having a sequence complementary to the antisense strand of the dsRNA duplex. Cleavage of the target RNA may take place in the middle of the region complementary to the antisense strand of the dsRNA duplex (Elbashir et al., Genes Dev., 2001, 15(2):188-200). In more detail, longer dsRNAs are digested into short (17-29 bp) dsRNA fragments (also referred to as short inhibitory RNAs, "siRNAs") by type III RNAses (DICER, DROSHA, etc.; Bernstein et al., Nature, 2001, 409(6818):363-6; Lee et al., Nature, 2003, 425(6956):415-9). The RISC protein complex recognizes these fragments and complementary mRNA. The whole process is culminated by endonuclease cleavage of target mRNA (McManus & Sharp, Nature Rev Genet, 2002, 3(10): 737-47; Paddison & Hannon, Curr Opin Mol Ther. 2003, 5(3):217-24). (For additional information on these terms and proposed mechanisms, see for example Bernstein et al., RNA 2001, 7(11):1509-21; Nishikura, Cell 2001, 107(4): 415-8 and PCT publication WO 01/36646).

The selection and synthesis of dsRNA corresponding to known genes has been widely reported; see for example Ui-Tei et al., J Biomed Biotechnol. 2006; 2006: 65052; Chalk et al., BBRC. 2004, 319(1): 264-74; Sioud & Leirdal, Met. Mol. Biol.; 2004, 252:457-69; Levenkova et al., Bioinform. 2004, 20(3):430-2; Ui-Tei et al., Nuc. Acid Res. 2004, 32(3):936-48. For examples of the use of, and production of, modified dsRNA see Braasch et al., Biochem., 2003, 42(26):7967-75; Chiu et al., RNA, 2003, 9(9):1034-48; PCT publications WO 2004/015107 (Atugen); WO 02/44321 (Tuschl et al), and U.S. Pat. Nos. 5,898,031 and 6,107,094.

dsRNA Synthesis

Using proprietary algorithms and the known sequence of the target genes disclosed herein, the sequences of many potential dsRNAs are generated. dsRNA molecules according to the above specifications are prepared essentially as described herein.

The dsRNA compounds disclosed herein are synthesized by any of the methods that are well known in the art for synthesis of ribonucleic (or deoxyribonucleic) oligonucleotides. Such synthesis is, among others, described in Beaucage and Iyer, Tetrahedron 1992; 48:2223-2311; Beaucage and Iyer, Tetrahedron 1993; 49: 6123-6194 and Caruthers, et. al., Methods Enzymol. 1987; 154: 287-313; the synthesis of thioates is, among others, described in Eckstein, Ann. Rev. Biochem. 1985; 54: 367-402, the synthesis of RNA molecules is described in Sproat, in Humana Press 2005 edited by Herdewijn P.; Kap. 2: 17-31 and respective downstream processes are, among others, described in Pingoud et al., in IRL Press 1989 edited by Oliver R. W. A.; Kap. 7: 183-208.

Other synthetic procedures are known in the art, e.g. the procedures described in Usman et al., 1987, J. Am. Chem. Soc., 109, 7845; Scaringe et al., 1990, NAR., 18, 5433; Wincott et al., 1995, NAR. 23, 2677-2684; and Wincott et al., 1997, Methods Mol. Bio., 74, 59, may make use of common nucleic acid protecting and coupling groups, such as dimethoxytrityl at the 5'-end, and phosphoramidites at the 3'-end. The modified (e.g. 2'-β-methylated) nucleotides and unmodified nucleotides are incorporated as desired.

The oligonucleotides disclosed herein can be synthesized separately and joined together post-synthetically, for example, by ligation (Moore et al., 1992, Science 256, 9923; Draper et al., International Patent Publication No. WO 93/23569; Shabarova et al., 1991, NAR 19, 4247; Bellon et al., 1997, Nucleosides & Nucleotides, 16, 951; Bellon et al., 1997, Bioconjugate Chem. 8, 204), or by hybridization following synthesis and/or deprotection.

It is noted that a commercially available machine (available, inter alia, from Applied Biosystems) can be used; the oligonucleotides are prepared according to the sequences disclosed herein. Overlapping pairs of chemically synthesized fragments can be ligated using methods well known in the art (e.g., see U.S. Pat. No. 6,121,426). The strands are synthesized separately and then are annealed to each other in the tube. Then, the double-stranded RNAs are separated from the single-stranded oligonucleotides that were not annealed (e.g. because of the excess of one of them) by HPLC. In relation to the dsRNAs or dsRNA fragments disclosed herein, two or more such sequences can be synthesized and linked together for use herein.

The compounds disclosed herein can also be synthesized via tandem synthesis methodology, as described for example in US Patent Publication No. US 2004/0019001, wherein both dsRNA strands are synthesized as a single contiguous oligonucleotide fragment or strand separated by a cleavable linker which is subsequently cleaved to provide separate RNA fragments or strands that hybridize and permit purification of the RNA duplex. The linker is selected from a polynucleotide linker or a non-nucleotide linker.

Pharmaceutical Compositions

While it is possible for the compounds disclosed herein to be administered as the raw chemical, it is preferable to present them as a pharmaceutical composition. Accordingly disclosed herein is a pharmaceutical composition comprising one or more of the chemically modified dsRNA compounds disclosed herein; and a pharmaceutically acceptable excipient or carrier. In some embodiments the pharmaceutical composition comprises two or more novel dsRNA compounds as disclosed herein.

Further disclosed herein is a pharmaceutical composition comprising at least one double stranded RNA molecule covalently or non-covalently bound to one or more compounds disclosed herein in an amount effective to inhibit the TLR2, TLR4, MYD88, TICAM1 and TIRAP genes; and a pharmaceutically acceptable carrier. In some embodiments the dsRNA compounds are processed intracellularly by endogenous cellular complexes/enzymes to produce one or more molecules as disclosed herein.

Further disclosed herein is a pharmaceutical composition comprising a pharmaceutically acceptable carrier and one or more of the chemically modified dsRNA compounds disclosed herein in an amount effective to inhibit expression in a cell of a target gene, the compound comprising a sequence which is substantially complementary to the sequence of target mRNA, set forth in SEQ ID NOS:1-12. Preferred oligonucleotide sequences useful in generating double-stranded nucleic acid molecules for therapeutic use are set forth in SEQ ID NOS:13-5846 (targeting TLR2), SEQ ID NOS:5847-12144 (targeting TLR4), SEQ ID NOS:12145-16332 (targeting MYD88), SEQ ID NOS:16333-18242 (targeting TICAM1) and SEQ ID NOS:18243-20606 (targeting TIRAP), and preferably SEQ ID NOS:20607-20684.

In some embodiments, the dsRNA compounds disclosed herein are the main active component in a pharmaceutical composition. In other embodiments the dsRNA compounds disclosed herein are one of the active components of a pharmaceutical composition containing two or more dsRNAs, said pharmaceutical composition further being comprised of one or more additional dsRNA molecule which targets the genes disclosed herein. In other embodiments the dsRNA compounds disclosed herein are one of the active components of a pharmaceutical composition containing two or more dsRNAs, said pharmaceutical composition further being comprised of one or more additional dsRNA molecule which targets one or more additional gene. In some embodiments, simultaneous inhibition of the target gene by two or more dsRNA compounds as disclosed herein provides additive or synergistic effect for treatment of the diseases disclosed herein. In some embodiments, simultaneous inhibition of for example TLR2 gene and TLR4 provides additive or synergistic effect for treatment of the diseases disclosed herein.

In some embodiments, the dsRNA compounds disclosed herein are linked or bound (covalently or non-covalently) to an antibody or aptamer against cell surface internalizable molecules expressed on the target cells, in order to achieve enhanced targeting for treatment of the conditions disclosed herein. In one specific embodiment, anti-Fas antibody (preferably a neutralizing antibody) is combined (covalently or non-covalently) with a double stranded RNA molecule, such as an siRNA as disclosed herein. In various embodiments, an aptamer which acts like a ligand/antibody is combined (covalently or non-covalently) with a double stranded RNA molecule, such as an siRNA as disclosed herein.

Delivery

The chemically modified double stranded RNA molecule is administered as the compound per se (e.g. as naked siRNA) or as pharmaceutically acceptable salt and is administered alone or as an active ingredient in combination with one or more pharmaceutically acceptable carrier, solvent, diluent, excipient, adjuvant and vehicle. In some embodiments, the dsRNA molecules as disclosed herein are delivered to the target tissue by direct application of the naked molecules prepared with a carrier or a diluent.

The term "naked siRNA" refers to siRNA molecules that are free from any delivery vehicle that acts to assist, promote or facilitate entry into the cell, including viral sequences, viral particles, liposome formulations, lipofectin or precipitating agents and the like. For example, siRNA in PBS is "naked siRNA".

Delivery systems aimed specifically at the enhanced and improved delivery of dsRNA into mammalian cells have been developed (see, for example, Shen et al FEBS Let. 539: 111-114 (2003), Xia et al., Nat. Biotech. 20: 1006-1010 (2002), Reich et al., Mol. Vision 9: 210-216 (2003), Sorensen et al., J. Mol. Biol. 327: 761-766 (2003), Lewis et al., Nat. Gen. 32: 107-108 (2002) and Simeoni et al., NAR 31, 11: 2717-2724 (2003)). siRNA has recently been successfully used for inhibition of gene expression in primates (see for example, Tolentino et al., Retina 2004. 24(1):132-138).

Pharmaceutically acceptable carriers, solvents, diluents, excipients, adjuvants and vehicles generally refer to inert, non-toxic solid or liquid fillers, diluents or encapsulating material not reacting with the active siRNA compounds disclosed herein. For example, the siRNA compounds disclosed herein may be formulated with polyethylenimine (PEI), with PEI derivatives, e.g. oleic and stearic acid modified derivatives of branched PEI, with chitosan or with poly(lactic-co-glycolic acid) (PLGA). Formulating the compositions in e.g. liposomes, micro- or nano-spheres and nanoparticles, may enhance stability and benefit absorption.

Additionally, the compositions may include an artificial oxygen carrier, such as perfluorocarbons (PFCs) e.g. perfluorooctyl bromide (perflubron), since different respiratory treatment modalities (e.g., liquid ventilation or aerosolized PFCs) have been shown to decrease pulmonary inflammatory responses in addition to improving lung compliance in animal models of lung injury and in clinical trials (Lehmler H J. 2008. Expert Review of Respiratory Medicine, vol. 2, No. 2: 273-289).

Examples of delivery systems as disclosed herein include U.S. Pat. Nos. 5,225,182; 5,169,383; 5,167,616; 4,959,217; 4,925,678; 4,487,603; 4,486,194; 4,447,233; 4,447,224; 4,439,196; and 4,475,196. Many such delivery systems, and modules are well known to those skilled in the art. In specific embodiments, formulations for inhalation are selected.

Accordingly, in some embodiments the siRNA molecules disclosed herein are delivered in liposome formulations and lipofectin formulations and the like and are prepared by methods well known to those skilled in the art. Such methods are described, for example, in U.S. Pat. Nos. 5,593,972, 5,589,466, and 5,580,859, which are herein incorporated by reference.

Additional formulations for improved delivery of the compounds as disclosed herein can include conjugation of siRNA molecules to a targeting molecule. The conjugate is usually formed through a covalent attachment of the targeting molecule to the sense strand of the siRNA, so as not to disrupt silencing activity. Potential targeting molecules useful herein include proteins, peptides and aptamers, as well as natural compounds, such as e.g. cholesterol. For targeting antibodies, conjugation to a protamine fusion protein has been used (see for example: Song et al., Antibody mediated in vivo delivery of small interfering RNAs via cell-surface receptors, Nat Biotechnol. 2005. 23(6):709-17).

The naked siRNA or the pharmaceutical compositions comprising the chemically modified siRNA as disclosed herein are administered and dosed in accordance with good medical practice, taking into account the clinical condition of the individual patient, the disease to be treated, the site and method of administration, scheduling of administration, patient age, sex, body weight and other factors known to medical practitioners.

A "therapeutically effective dose" for purposes herein is thus determined by such considerations as are known in the art. The dose must be effective to achieve improvement including but not limited to improved survival rate or more rapid recovery, or improvement or elimination of symptoms and other indicators as are selected as appropriate measures by those skilled in the art. The siRNA disclosed herein can be administered in a single dose or in multiple doses.

In general, the active dose of a dsRNA compound for humans is in the range of from 1 ng/kg to about 20-100 mg/kg body weight per dose, preferably about 0.01 mg to about 2-10 mg/kg body weight per dose, in a regimen of a single dose or a series of doses given at short (e.g. 1-5 minute) intervals, administered within several minutes to several hours after perfusion.

The chemically modified dsRNA compounds as disclosed herein are administered by any of the conventional routes of administration. The chemically modified dsRNA compounds are administered orally, subcutaneously or parenterally including intravenous, intraarterial, intramuscular, intraperitoneally, intraocular, intracoronary, transtympanic and intranasal administration as well as intrathecal and infusion techniques. Implants of the compounds are also useful.

Liquid forms are prepared for invasive administration, e.g. injection or for topical or local administration. The term injection includes subcutaneous, transdermal, intravenous, intramuscular, intrathecal, intraocular, transtympanic and other parental routes of administration. The liquid compositions include aqueous solutions, with and without organic co-solvents, aqueous or oil suspensions, emulsions with edible oils, as well as similar pharmaceutical vehicles.

In embodiments wherein the subject has undergone lung transplantation, therapeutic compounds and compositions as disclosed herein are preferably administered into a of the subject by inhalation of an aerosol containing these compositions/compounds, by intranasal or intratracheal instillation of said compositions or by inhalation via ventilation machine (e.g. for administration to an unconscious patient). In some embodiments the siRNA compounds as disclosed herein are administered by inhalation into the lung of a subject who has undergone lung transplantation. For further information on pulmonary delivery of pharmaceutical compositions see Weiss et al., Human Gene Therapy 1999. 10:2287-2293; Densmore et al., Molecular therapy 1999. 1:180-188; Gautam et al., Molecular Therapy 2001. 3:551-556; and Shahiwala & Misra, AAPS PharmSciTech 2004. 24; 6(3):E482-6. Additionally, respiratory formulations for siRNA are described in U.S. Patent Application Publication No. 2004/0063654. Respiratory formulations for siRNA are described in US Patent Application Publication No. 2004/0063654. International Patent Publication No. WO 2008/132723 to the assignee of the present invention, and hereby incorporated by reference in its entirety discloses therapeutic delivery of siRNA to the respiratory system.

In some embodiments, the chemically modified dsRNA compounds as disclosed herein are formulated for systemic delivery for example by intravenous administration.

In addition, in certain embodiments the compositions for use in the novel treatments disclosed herein are formed as aerosols, for example for intranasal administration. In certain embodiments the compositions for use in the novel treatments disclosed herein are formed as nasal drops, for example for intranasal instillation.

Methods of Treatment

In one aspect disclosed herein is a method of treating a subject suffering from a posttransplantational complication, injury or condition associated with TLR2, TLR4, MYD88, TICAM1 and TIRAP expression or activity comprising administering to the subject a therapeutically effective amount of an siRNA compound as disclosed herein. In preferred embodiments the subject being treated is a warm-blooded animal and, in particular, mammal including human.

"Treating a subject" refers to administering to the subject a therapeutic substance effective to ameliorate symptoms associated with a condition, a complication or an injury, to lessen the severity or cure the condition, or to prevent the condition from occurring. "Treatment" refers to both therapeutic treatment and prophylactic or preventative measures, wherein the object is to prevent a condition, a complication or an injury or reduce the symptoms thereof. Those in need of treatment include those already experiencing the condition, those prone to having the condition, and those in which the condition is to be prevented. The compounds disclosed herein are administered before, during or subsequent to the onset of the condition. In various embodiments the subject is being treated after organ transplantation (such as lung transplantation) for a condition, a complication or an injury selected from, without being limited to, chronic or acute aseptic inflammation, neuropathic pain, primary graft failure, ischemia-reperfusion injury, reperfusion injury, reperfusion edema, allograft dysfunction, pulmonary reimplantation response and/or primary graft dysfunction (PGD).

A "therapeutically effective dose" refers to an amount of a pharmaceutical compound or composition which is effective to achieve an improvement in a subject or his physiological systems including, but not limited to, improved survival rate, more rapid recovery, or improvement or elimination of symptoms, and other indicators as are selected as appropriate determining measures by those skilled in the art.

The methods of treating the diseases disclosed herein include administering a TLR2, TLR4, MYD88, TICAM1 and TIRAP dsRNA inhibitor in conjunction or in combination with an additional inhibitor, a substance which improves the pharmacological properties of the active ingredient (e.g. siRNA) as detailed below, or an additional compound known to be effective in the treatment of a subject suffering from or susceptible to any of the hereinabove mentioned conditions, complications and disorders (e.g. immunosuppressants). In another aspect, provided herein is a combination of a therapeutic double stranded RNA molecule together with at least one additional therapeutically active agent. Additionally, the provided is a method of down-regulating the expression of a target gene by at least 40% as compared to a control, comprising contacting a target gene mRNA with one or more of the chemically modified RNA compounds as disclosed herein.

In one embodiment the chemically modified dsRNA compound as disclosed herein inhibits or down-regulates the mammalian TLR2, TLR4, MYD88, TICAM1 and TIRAP gene whereby the inhibition or down-regulation is selected from the group comprising inhibition of down-regulation of gene function, inhibition or down-regulation of polypeptide and inhibition and down-regulation of mRNA expression.

Disclosed herein is a method of inhibiting the expression of the TLR2, TLR4, MYD88, TICAM1 and TIRAP gene by at least 40%, preferably by 50%, 60% or 70%, more preferably by 75%, 80% or 90% as compared to a control comprising contacting an mRNA transcript of the TLR2, TLR4, MYD88, TICAM1 and TIRAP gene with one or more of the dsRNA compounds disclosed herein.

In one embodiment the effect of inhibition by the chemically modified siRNA compound disclosed herein is determined by examining siRNA effect on the mRNA or on the corresponding protein whereby the inhibition is selected from the group consisting of inhibition of function (which is examined by, for example, an enzymatic assay or a binding assay with a known interactor of the native gene/polypeptide, inter alia), inhibition of protein (which is examined by, for example, Western blotting, ELISA or immuno-precipitation, inter alia) and inhibition of target gene mRNA expression (which is examined by, for example, Northern blotting, quantitative RT-PCR, in-situ hybridization or microarray hybridization, inter alia).

In one embodiment the chemically modified double stranded RNA molecule is down-regulating the TLR2, TLR4, MYD88, TICAM1 and TIRAP gene or polypeptide, whereby the down-regulation is selected from the group consisting of down-regulation of function (which is examined by, for example, an enzymatic assay or a binding assay with a known interactor of the native gene/polypeptide, inter alia), down-regulation of protein (which is examined by, for example, Western blotting, ELISA or immuno-precipitation, inter alia) and down-regulation of target gene mRNA expression (which is examined by, for example, Northern blotting, quantitative RT-PCR, in-situ hybridization or microarray hybridization, inter alia).

In additional embodiments there is provided a method of treating a subject after organ transplantation (such as lung transplantation), wherein the subject is suffering from or susceptible to any condition, complication or disorder accompanied by an elevated level of a mammalian TLR2, TLR4, MYD88, TICAM1 and TIRAP gene, the method comprising administering to the subject a chemically modified siRNA compound or composition as disclosed herein in a therapeutically effective dose thereby treating the subject.

Provided herein is the use of a compound which down-regulates the expression of a mammalian gene selected from TLR2, TLR4, MYD88, TICAM1 and TIRAP gene, particularly to novel small interfering RNAs (siRNAs), in the treatment of chronic or acute aseptic inflammation, neuropathic pain, primary graft failure, ischemia-reperfusion injury, reperfusion injury, reperfusion edema, allograft dysfunction, pulmonary reimplantation response and/or primary graft dysfunction (PGD) in which inhibition of the expression of the mammalian TLR2, TLR4, MYD88, TICAM1 and TIRAP gene is beneficial.

Methods, novel chemically modified dsRNA molecules and pharmaceutical compositions comprising said dsRNA compounds which inhibit a mammalian TLR2, TLR4, MYD88, TICAM1 and TIRAP gene or polypeptide expression are discussed herein at length, and any of said dsRNA molecules and/or pharmaceutical compositions are beneficially employed in the treatment of a subject suffering from or susceptible to any of said conditions. It is to be explicitly understood that known compounds are excluded from the present invention. Novel methods of treatment using known compounds and compositions fall within the scope of the present invention.

The method disclosed herein includes administering a therapeutically effective amount of one or more of the chemically modified dsRNA compounds disclosed herein which down-regulate expression of a TLR2, TLR4, MYD88, TICAM1 and TIRAP gene.

Also disclosed herein is a process of preparing a pharmaceutical composition, which comprises:

providing one or more chemically modified double stranded RNA molecule; and admixing said compound with a pharmaceutically acceptable carrier.

In a preferred embodiment, the dsRNA compound used in the preparation of a pharmaceutical composition is admixed with a carrier in a pharmaceutically effective dose. In one embodiment the chemically modified dsRNA compound as disclosed herein is conjugated to a steroid or to a lipid or to another suitable targeting molecule e.g. to protein, peptide, aptamer, natural compound (e.g. cholesterol, xylose).

Combination Therapy

The methods of treating the diseases disclosed herein include administering a novel chemically modified double stranded RNA molecule in conjunction or in combination with an additional TLR2, TLR4, MYD88, TICAM1 and TIRAP inhibitor, a substance which improves the pharmacological properties of the chemically modified dsRNA compound, or an additional compound known to be effective in the treatment of a subject suffering from or susceptible to a complication or injury post organ transplantation, for example lung transplantation, such as, without being limited to, primary graft failure, ischemia-reperfusion injury, reperfusion injury, reperfusion edema, allograft dysfunction, pulmonary reimplantation response and/or primary graft dysfunction (PGD), chronic or acute aseptic inflammation, or neuropathic pain.

In another aspect, provided herein is a pharmaceutical composition comprising a combination of a therapeutic double stranded RNA molecule together with at least one additional therapeutically active agent. By "in conjunction with" or "in combination with" is meant prior to, simultaneously or subsequent to. Accordingly, the individual components of such a combination are administered either sequentially or simultaneously from the same or separate pharmaceutical formulations.

Combination therapies comprising known treatments for treating a subject prone to a complication or injury post organ transplantation, for example, lung transplantation, such as, without being limited to, primary graft failure, ischemia-reperfusion injury, reperfusion injury, reperfusion edema, allograft dysfunction, pulmonary reimplantation response and/or primary graft dysfunction (PGD), in conjunction with the novel chemically modified dsRNA compounds and therapies described herein are considered part of the current invention. Such known treatments include, without being limited to, pharmacological immunosuppression.

In addition, the dsRNA compounds disclosed herein are used in the preparation of a medicament for use as adjunctive therapy with a second therapeutically active compound (e.g. immunosuppressive agent) to treat such conditions. Appropriate doses of known second therapeutic agent for use in combination with a chemically modified double stranded RNA molecule are readily appreciated by those skilled in the art.

In some embodiments the combinations referred to above are presented for use in the form of a single pharmaceutical formulation.

The administration of a pharmaceutical composition comprising any one of the pharmaceutically active siRNA compounds disclosed herein is carried out by any of the many known routes of administration, including intravenously, intra-arterially, by intranasal or intratracheal instillation or by inhalation as determined by a skilled practitioner. Using specialized formulations, it is possible to administer the compositions intracoronary, via inhalation or via intranasal instillation.

By "in conjunction with" is meant that the additional pharmaceutically effective compound is administered prior to, at the same time as, or subsequent to administration of the pharmaceutical compositions of present invention. The individual components of such a combination referred to above, therefore, are administered either sequentially or simultaneously from the same or separate pharmaceutical formulations. As is the case for the present siRNA compounds, a second therapeutic agent is administered by any as detailed above, for example, but not limited to oral, buccal, inhalation, sublingual, rectal, vaginal, transurethral, nasal, topical, percutaneous (i.e., transdermal), or parenteral (including intravenous, intramuscular, subcutaneous, and intracoronary) administration.

In some embodiments, a chemically modified double stranded RNA molecule disclosed herein and the second therapeutic agent are administered by the same route, either provided in a single composition or as two or more different pharmaceutical compositions. However, in other embodiments, a different route of administration for the novel double stranded RNA molecule disclosed herein and the second therapeutic agent is possible. Persons skilled in the art are aware of the best modes of administration for each therapeutic agent, either alone or in combination.

In another aspects, provided herein is a pharmaceutical composition comprising two or more dsRNA molecules for the treatment of any of the complications and conditions mentioned herein. In some embodiments the two or more dsRNA molecules or formulations comprising said molecules are admixed in the pharmaceutical composition in amounts which generate equal or otherwise beneficial activity. In certain embodiments the two or more dsRNA molecules are covalently or non-covalently bound, or joined together by a nucleic acid linker of a length ranging from 2-100, preferably 2-50 or 2-30 nucleotides. In one embodiment, the two or more dsRNA molecules target mRNA to TLR2, TLR4, MYD88, TICAM1 and TIRAP. In some embodiments at least one of the two or more dsRNA compounds target TLR2, TLR4, MYD88, TICAM1 and TIRAP RNA. In some embodiments at least one of the RNA compounds comprises an antisense sequence substantially identical to an antisense sequence set for the in any one of SEQ ID NOS: 13-20606. In some embodiments the dsRNA sense and antisense oligonucleotides are selected from sense and corresponding (complementary) antisense oligonucleotides set forth in any one of SEQ ID NOS: 13-20606. Preferred sense and antisense oligonucleotide pairs are set forth in Tables 1-5, herein below.

In some embodiments the pharmaceutical compositions disclosed herein further comprise one or more additional dsRNA molecule, which targets one or more additional gene. In some embodiments, simultaneous inhibition of said additional gene(s) provides an additive or synergistic effect for treatment of the complication, injury or disorder disclosed herein.

The treatment regimen disclosed herein is carried out, in terms of administration mode, timing of the administration, and dosage, so that the functional recovery of the patient from the adverse consequences of the conditions disclosed herein is improved.

In some embodiments the pharmaceutical compositions disclosed herein further comprise one or more additional dsRNA molecule, which targets one or more additional gene. In some embodiments, simultaneous inhibition of said additional gene(s) provides an additive or synergistic effect for treatment of the diseases disclosed herein.

The treatment regimen disclosed herein is carried out, in terms of administration mode, timing of the administration, and dosage, so that the functional recovery of the patient from the adverse consequences of the conditions disclosed herein is improved or so as to postpone the onset of a disorder. Effective concentrations of individual nucleic acid molecule in a cell may be about 1 femtomolar, about 50 femtomolar, 100 femtomolar, 1 picomolar, 1.5 picomolar, 2.5 picomolar, 5 picomolar, 10 picomolar, 25 picomolar, 50 picomolar, 100 picomolar, 500 picomolar, 1 nanomolar, 2.5 nanomolar, 5 nanomolar, 10 nanomolar, 25 nanomolar, 50 nanomolar, 100 nanomolar, 500 nanomolar, 1 micromolar, 2.5 micromolar, 5 micromolar, 10 micromolar, 100 micromolar or more.

An appropriate dosage for a mammal may be from 0.01 mg to 1 g per kg of body weight (e.g., 0.1 mg, 0.25 mg, 0.5 mg, 0.75 mg, 1 mg, 2.5 mg, 5 mg, 10 mg, 25 mg, 50 mg, 100 mg, 250 mg, 500 mg, 1 mg, 2.5 mg, 5 mg, 10 mg, 25 mg, 50 mg, 100 mg, 250 mg, or 500 mg per kg).

Dosage levels of from about 0.01 mg to about 100 mg per kilogram of body weight per day are useful in the treatment of the above-indicated conditions. The amount of active ingredient that can be combined with a carrier to produce a single dosage form varies depending upon the host treated and the particular mode of administration. Dosage unit forms generally contain between from about 0.1 mg to about 500 mg of an active ingredient. Dosage units may be adjusted for local delivery, for example for intravitreal delivery of for transtympanic delivery.

Kits

In another aspect a kit is provided comprising a therapeutic agent consisting of a double-stranded nucleic acid that targets TLR2; optionally with instructions for use. In some embodiments the double-stranded nucleic acid that targets TLR2 comprises a oligonucleotide having a sequence set forth in SEQ ID NOS:13-5846.

In another aspect a kit is provided comprising a therapeutic agent consisting of a double-stranded nucleic acid that targets TLR4; optionally with instructions for use. In some embodiments the double-stranded nucleic acid that targets TLR4 comprises a oligonucleotide having a sequence set forth in SEQ ID NOS:5847-12144.

In another aspect a kit is provided comprising a therapeutic agent consisting of a double-stranded nucleic acid that targets MYD88; optionally with instructions for use. In some embodiments the double-stranded nucleic acid that targets MYD88 comprises a oligonucleotide having a sequence set forth in SEQ ID NOS:12145-16332.

In another aspect a kit is provided comprising a therapeutic agent consisting of a double-stranded nucleic acid that targets TICAM1; optionally with instructions for use. In some embodiments the double-stranded nucleic acid that targets TICAM1 comprises a oligonucleotide having a sequence set forth in SEQ ID NOS:16333-18242.

In another aspect a kit is provided comprising a therapeutic agent consisting of a double-stranded nucleic acid that targets TIRAP; optionally with instructions for use. In some embodiments the double-stranded nucleic acid that targets TIRAP comprises a oligonucleotide having a sequence set forth in SEQ ID NOS:18243-20606.

In another aspect provided is a kit comprising at least two therapeutic agents wherein the two agents are selected from the group consisting of a TLR2 inhibitor, a TLR4 inhibitor, a MYD88 inhibitor, a TICAM1 inhibitor and a TIRAP inhibitor; optionally with instructions for use.

In some embodiments of the kit each therapeutic agent is independently selected from the group consisting of a short interfering nucleic acid (siNA), a short interfering RNA (siRNA), a double-stranded RNA (dsRNA), a micro-RNA (miRNA) or short hairpin RNA (shRNA) that binds a nucleotide sequence (such as an mRNA sequence) encoding the target gene selected from TLR2, TLR4, MYD88, TICAM1 and TIRAP. In some embodiments each nucleic acid molecule is a double-stranded RNA (dsRNA) or a short interfering RNA (siRNA). In some embodiments each nucleic acid molecule is selected from the group consisting of a dsRNA targeting TLR2, TLR4, MYD88, TICAM1 and TIRAP. In some embodiments the kit provided herein comprises a combined inhibitor by which it is meant a single agent which is capable of inhibiting at least two genes and/or gene products selected from the group consisting of TLR2, TLR4, MYD88, TICAM1 and TIRAP; optionally with instructions for use.

In some embodiments each therapeutic agent of the kit comprises a nucleic acid molecule, wherein:
(a) the nucleic acid molecule includes a sense strand and an antisense strand;
(b) each strand of the nucleic acid molecule is independently 17 to 40 nucleotides in length;
(c) a 17 to 40 nucleotide sequence of the antisense strand is complementary to a sequence of an mRNA selected from an mRNA encoding TLR2, TLR4, MYD88, TICAM1 or TIRAP
(d) a 17 to 40 nucleotide sequence of the sense strand is complementary to the antisense strand and includes a 17 to 40 nucleotide sequence of a mRNA selected from a mRNA encoding TLR2, TLR4, MYD88, TICAM1 or TIRAP
Indications
Lung Injury, Lung Ischemia Reperfusion Injury
Lung Transplantation Lung transplantation is a surgical procedure in which a patient's diseased lungs are partially or totally replaced by lungs which come from a donor. Lung transplantation has become a treatment of choice for patients with advanced/end-stage lung diseases. Within last decades, donor management, organ preservation, immunosuppressive regimens and control of infectious complications have been substantially improved and the operative techniques of transplantation procedures have been developed. Nonetheless, primary graft dysfunction (PGD) affects an estimated 10 to 25% of lung transplants and is the leading cause of early post-transplantation morbidity and mortality for lung recipients (Lee J C and Christie J D. 2009. Proc Am Thorac Soc, vol. 6: 39-46). PGD has variably been referred to as primary graft failure, ischemia-reperfusion injury, reperfusion injury, reperfusion edema, allograft dysfunction, and pulmonary reimplantation response. In addition, there is some evidence to suggest a relationship between reperfusion injury, acute rejection, and the subsequent development of chronic graft dysfunction.

Effective oligonucleotide based therapies useful in preventing or treating chronic or acute aseptic inflammation, neuropathic pain, primary graft failure, ischemia-reperfusion injury, reperfusion injury, reperfusion edema, allograft dysfunction, pulmonary reimplantation response and/or primary graft dysfunction (PGD) after organ transplantation, in particular in lung transplantation, would be of great therapeutic value.

In various embodiments the chemically modified dsRNA compounds disclosed herein are useful for treating or preventing complications or injury post lung transplantation, such as, without being limited to, chronic or acute aseptic inflammation, neuropathic pain, primary graft failure, ischemia-reperfusion injury, reperfusion injury, reperfusion edema, allograft dysfunction, pulmonary reimplantation response and/or primary graft dysfunction (PGD).

The term "lung transplantation" is meant to encompass a surgical procedure in which a patient's diseased lungs are partially or totally replaced by lungs which come from a donor. Although a xenotransplant can be contemplated in certain situations, an allotransplant is usually preferable.

Indications for lung transplantation include chronic obstructive pulmonary disease (COPD), pulmonary hypertension, cystic fibrosis, idiopathic pulmonary fibrosis, and Eisenmenger syndrome. Typically, four different surgical techniques are used: single-lung transplantation, bilateral sequential transplantation, combined heart-lung transplantation, and lobar transplantation, with the majority of organs obtained from deceased donors.

The dsRNA compounds disclosed herein are particularly useful in treating a subject experiencing a medical complication of lung transplantation, including, without being limited to, ameliorating, attenuating, treating or preventing any of the following: chronic or acute aseptic inflammation, neuropathic pain, primary graft failure, ischemia-reperfusion injury, reperfusion injury, reperfusion edema, allograft dysfunction, pulmonary reimplantation response and/or primary graft dysfunction (PGD).

In some embodiments the target gene is selected from MYD88, TICAM1, TLR2, TLR4 and TIRAP. In yet other embodiments the sense and antisense oligonucleotide sequences useful in synthesizing siRNA compounds are set forth in set forth in SEQ ID NOS:13-5846 (targeting TLR2), SEQ ID NOS:5847-12144 (targeting TLR4), SEQ ID NOS: 12145-16332 (targeting MYD88), SEQ ID NOS:16333-18242 (targeting TICAM1) and SEQ ID NOS:18243-20606 (targeting TIRAP).

Acute Lung Injury (ALI)/Acute Respiratory Distress Syndrome (ARDS)

Acute respiratory distress syndrome (ARDS), also known as respiratory distress syndrome (RDS) is a serious reaction to various forms of injuries to the lung. This is the most relevant disorder resulting in increased permeability pulmonary edema ARDS is a severe lung disease caused by a variety of direct and indirect insults. It is characterized by inflammation of the lung parenchyma leading to impaired gas exchange with concomitant systemic release of inflammatory mediators which cause inflammation, hypoxemia and frequently result in failure of multiple organs. This condition is life threatening and often lethal, usually requiring mechanical ventilation and admission to an intensive care unit. A less severe form is called acute lung injury (ALI).

In some embodiments the molecules and methods disclosed herein are useful for treating or preventing the incidence or severity of acute lung injury, in particular conditions which result from ischemic/reperfusion injury or oxidative stress. For example, acute respiratory distress syndrome (ARDS) due to coronavirus infection or endotoxins, severe acute respiratory syndrome (SARS), ischemia reperfusion injury associated with lung transplantation and other acute lung injuries.

Inflammatory Conditions

Inflammatory conditions where the present compounds find use are asthmatic conditions, Crohn's disease, ulcerous colitis, reperfusion injury, auto-immune diseases, inflammatory bowel disease (IBD), atherosclerosis, restenosis, coronary heart disease, diabetes, rheumatoidal diseases, dermatological diseases, such as psoriasis and seborrhea, graft rejection, and inflammation of the lungs, heart, kidney, oral cavity, uterus.

Neuropathic Pain

Neuropathic pain is complex, chronic pain state often accompanied by tissue injury or dysfunction. Neuropathic pain may occur due to lesions or diseases affecting the somatosensory system and is characterized by hyperalgesia, spontaneous pain and allodynia. Allodynia is pain in response to a nonnociceptive stimulus or pain due to a stimulus which does not normally provoke a pain response and can be elicited as a hypersensitivity to either thermal or mechanical stimuli that are not normally sensed as pain.

Neuropathic pain may be caused by spinal cord injury (SCI), or injury of peripheral nerves (PNI), dorsal root ganglions or the brain. In humans, chronic pain elicited as burning, stabbing and/or electric-like sensations can develop within months after injury. Another cause of neuropathic pain is diabetes mellitus. Diabetic neuropathy is one of the most common complications of diabetes mellitus and allodynia is one of its symptoms. Additional causes of neuropathic pain include herpes zoster infection, HIV-related neuropathies, limb amputation, nutritional deficiencies, toxins, genetic and immune mediated disorders. Neuropathic pain may appear in cancer patients due to tumors pressing on peripheral nerves or as a side effect of treatment (e.g. chemotherapy with taxanes).

Allodynia and Spinal Cord Injury (SCI)

Chronic pain is one of the more frequent and troublesome sequelae of SCI, often interfering with the effective rehabilitation of the patient. In addition to the chronic pain syndromes seen in the non-SCI population, e.g., migraine and postherpetic neuralgia, patients with SCI may also suffer from pain syndromes unique to SCI. The reported prevalence of chronic SCI pain varies between 25% and 94%, with almost one-third of these patients experiencing severe pain (Bonica J J. Introduction: semantic, epidemiologic, and educational issues. In: Casey K L, ed. Pain and central nervous system disease: the central pain syndromes. New York: Raven Press, 1991:13-29; Siddall P J, et al. Pain 1999; 81:187-97; Gerhart K A, et al. Paraplegia 1992; 30:282-7). Several studies have reported the prevalence of the various types of SCI pain. Musculoskeletal pain was the most common type experienced at 6 mo after injury (40%) (Siddall P J, *Pain* 1999; 8/:187-97) and at 5 yr after SCI (59%) (Siddall P J, et al. Pain 2003; 103:249-57). An increase in the prevalence of at-level and below-level neuropathic pain has likewise been observed more than 5 yr after SCI. Variables that influence the development of SCI pain remain unclear. Factors such as the level of the injury, completeness of the injury, cause of injury, and psychosocial factors have been considered (Siddall P J, et al. In: Yezierski R P, Burchiel K J, eds. *Spinal cord injury pain: assessment, mechanisms, management. Progress in Pain Research and Management. Vol.* 23 Seattle: IASP Press, 2002:9-24). Musculoskeletal pain was more common in patients with thoracic level injuries and was reported to be more prevalent in those who had surgical intervention 2 wk after SCI (Sved P, et al. Spinal Cord 1997; 35:526-30). Neuropathic pain that was associated with allodynia was observed to be more common in patients with incomplete spinal cord lesions, in cervical than thoracic cord injuries, and in central cord syndrome (Siddall P J, et al. *Pain* 1999; 81:187-97).

Post-SCI Pain Types

In addition to the four major types of SCI pain under Tier 2, there are other recognized pain conditions, most of which are under Tier 3 in the International Association for the Study of Pain Taxonomy (Siddall P J, et al. International Association for the Study of Pain Newsletter 2000; 3:3-7). These need to be clinically identified so that appropriate treatment may be instituted.

Musculoskeletal Pain

Mechanical Instability of the Spine:

This type of pain is brought about by disruption of ligaments/joints or fractures of bone, resulting in instability of the spine. It occurs early after injury and is located in the region of the spine close to the site of SCI. It is related to position, worsened by activity and decreased by rest. Diagnosis is aided by radiographs, computerized tomography or MRI to identify the nature and site of pathology.

Muscle Spasm Pain:

Spasticity is defined as a motor disorder characterized by a velocity-dependent increase in the tonic stretch reflexes (muscle tone) with exaggerated tendon reflexes, resulting from hyperexcitability of the stretch reflex. An imbalance in any of the numerous excitatory and inhibitory modulatory synaptic influences on the a motor neuron and muscle results in hyperactivity of the stretch reflex arc. This pain type usually occurs late after SCI, and is often seen in people with incomplete SCI.

At-Level Neuropathic Pain

Segmental deafferentation/Girdle or Border or transitional zone pain: This is a variation of at-level neuropathic pain that occurs within a band of two to four segments above or below the level of SCI. It often occurs on the border of normal sensation and anesthetic skin.

Syringomyelia: Pain due to a syrinx (i.e., an abnormal cyst in the spinal cord) often occurs with a delayed onset, a mean of 6 yr. The damage to the central part of the spinal cord with cervical injuries results in the central cord syndrome characterized by pain and weakness of the arms and relatively strong but spastic leg function. The pain of syringomyelia is sometimes described as a constant burning pain with allodynia.

Below-Level Neuropathic Pain

Central dysaesthesia syndrome/central pain/deafferentation pain: pain diffusely located caudal to the level of SCI, i.e., over the entire body from the shoulders to the feet, typical of below-level neuropathic pain. The pain may be associated with hyperalgesia and may gradually worsen over time. It occurs with spontaneous and/or evoked episodes, and is often worsened by infections, sudden noise, and jarring movements.

Pathophysiology and Mechanisms of SCI Pain

Pain associated with SCI is a consequence of both injury characterized by pathological changes from mechanical trauma and vascular compromise of the cord parenchyma. It is influenced by the nature of the lesion, the neurological structures damaged, and the secondary pathophysiological changes of the surviving tissue. There are at least three proposed basic mechanisms underlying SCI pain: increased neuronal hyperexcitability, reduced inhibition, and neuronal reorganization or plasticity.

Increased Neuronal Hyperexcitability

An initial consequence of SCI after traumatic or ischemic SCI is the brief but dramatic increase of excitatory amino acids, which triggers an injury cascade of secondary pathological changes. The major components of this spinal "central injury cascade" include anatomical, neurochemical, excitotoxic, and inflammatory events that collectively interact to increase the responsiveness of the neurons at the level of injury, resulting in the generation of the clinical symptoms of allodynia and hyperalgesia (Yezierski R P. *Pathophysiology and animal models of spinal cord injury pain.* In: Yezierski R P, Burchiel K J, eds. *Spinal cord injury pain: assessment, mechanisms, management. Progress in pain research and management. Vol.* 23. Seattle: IASP Press, 2002:117-36).

Periodontitis

Periodontitis occurs when inflammation or infection of the gums is left untreated or treatment is delayed. Infection and inflammation spreads from the gingiva to the ligaments and bone that support the teeth, ultimately resulting in tooth loss. Inflammation caused by plaque and tartar accumulating at the base of the teeth traps the plaque in a pocket that forms between the teeth and the gingiva. Continued inflammation eventually causes destruction of the tissues and bone surrounding the tooth.

Synthesis of Modified Compounds

The compounds disclosed herein can be synthesized by any of the methods that are well known in the art for synthesis of ribonucleic (or deoxyribonucleic) oligonucleotides. Such synthesis is, among others, described in Beaucage and Iyer, Tetrahedron 1992; 48:2223-2311; Beaucage and Iyer, Tetrahedron 1993; 49: 6123-6194 and Caruthers, et. al., Methods Enzymol. 1987; 154: 287-313; the synthesis of thioates is, among others, described in Eckstein, Annu Rev. Biochem. 1985; 54: 367-402, the synthesis of RNA molecules is described in Sproat, in Humana Press 2005 edited by Herdewijn P.; Kap. 2: 17-31 and respective downstream processes are, among others, described in Pingoud et. al., in IRL Press 1989 edited by Oliver R. W. A.; Kap. 7: 183-208.

Other synthetic procedures are known in the art e.g. the procedures as described in Usman et al., J. Am. Chem. Soc., 1987, 109:7845; Scaringe et al., NAR, 1990, 18:5433; Wincott et al., NAR 1995. 23:2677-2684; and Wincott et al., Methods Mol. Bio., 1997, 74:59, and these procedures may make use of common nucleic acid protecting and coupling groups, such as dimethoxytrityl at the 5'-end, and phosphoramidites at the 3'-end. The modified (e.g. 2'-O-methylated) nucleotides and unmodified nucleotides are incorporated as desired.

The oligonucleotides disclosed herein can be synthesized separately and joined together post-synthetically, for example, by ligation (Moore et al., Science 1992, 256:9923; International Patent Publication No. WO 93/23569; Shabarova et al., NAR 1991, 19:4247; Bellon et al., Nucleosides & Nucleotides, 1997, 16:951; Bellon et al., Bioconjugate Chem 1997, 8:204), or by hybridization following synthesis and/or deprotection.

It is noted that a commercially available machine (available, inter alia, from Applied Biosystems) can be used; the oligonucleotides are prepared according to the sequences disclosed herein. Overlapping pairs of chemically synthesized fragments can be ligated using methods well known in the art (e.g., see U.S. Pat. No. 6,121,426). The strands are synthesized separately and then are annealed to each other in the tube. Then, the double-stranded oligonucleotides are separated from the single-stranded oligonucleotides that were not annealed (e.g. because of the excess of one of them) by HPLC. In relation to the siRNAs or siRNA fragments disclosed herein, two or more such sequences can be synthesized and linked together for use herein.

The compounds as disclosed herein can also be synthesized via tandem synthesis methodology, as described for example in US Patent Publication No. 2004/0019001 (McSwiggen), wherein both dsRNA strands are synthesized as a single contiguous oligonucleotide fragment or strand separated by a cleavable linker which is subsequently cleaved to provide separate RNA fragments or strands that hybridize and permit purification of the RNA duplex. The linker is selected from a polynucleotide linker or a non-nucleotide linker.

The term "Covalent bonding" as used herein refers to chemical bonding that is characterized by the sharing of pairs of electrons between atoms.

The term "noncovalent bonding" as used herein refers to a variety of interactions that are not covalent in nature between molecules or parts of molecules that provide force to hold the molecules or parts of molecules together, usually in a specific orientation or conformation. These noncovalent interactions include: ionic bonds, hydrophobic interactions, hydrogen bonds, Van der Waals forces and dipole-dipole bonds.

EXAMPLES

Without further elaboration, it is believed that one skilled in the art can, using the preceding description, utilize the present invention to its fullest extent. The following preferred specific embodiments are, therefore, to be construed as merely illustrative, and not limitative of the claimed invention in any way.

Standard molecular biology protocols known in the art not specifically described herein are generally followed essentially as in Sambrook et al., *Molecular cloning: A laboratory manual*, Cold Springs Harbor Laboratory, New-York (1989, 1992), and in Ausubel et al., *Current Protocols in Molecular Biology*, John Wiley and Sons, Baltimore, Md. (1988), and as in Ausubel et al., Current Protocols in Molecular Biology, John Wiley and Sons, Baltimore, Md. (1989) and as in Perbal, A Practical Guide to Molecular Cloning, John Wiley & Sons, New York (1988), and as in Watson et al., Recombinant DNA, Scientific American Books, New York and in Birren et al (eds) Genome Analysis: A Laboratory Manual Series, Vols. 1-4 Cold Spring Harbor Laboratory Press, New York (1998) and methodology as set forth in U.S. Pat. Nos. 4,666,828; 4,683,202; 4,801,531; 5,192,659 and 5,272,057 and incorporated herein by reference. Polymerase chain reaction (PCR) was carried out as in standard PCR Protocols: A Guide To Methods And Applications, Academic Press, San Diego, Calif. (1990). In situ PCR in combination with Flow Cytometry (FACS) can be used for detection of cells containing specific DNA and mRNA sequences (Testoni et al., Blood 1996, 87:3822.) Methods of performing qPCR and RT-PCR are well known in the art.

Example 1

Generation of Sequences for Active siRNA Compounds to the Target Genes and Production of the siRNAs Using proprietary algorithms and the known sequence of the genes of disclosed herein, the antisense and corresponding sense sequences of siRNA were generated. In addition to the algorithm, 20-, 21-, 22-, and 23-mer oligomer sequences are generated by 5' and/or 3' extension of the 19-mer sequences. The sequences that have been generated using this method are fully complementary to a segment of corresponding mRNA sequence.

SEQ ID NOS; 13-20606 provide oligonucleotide sequences useful in the preparation of dsRNA compounds as disclosed herein. Each oligonucleotide sequence is presented in 5' to 3' orientation.

For each gene there is a separate list of 19-mer sense and corresponding antisense oligonucleotide sequences, which are prioritized based on their score in the proprietary algorithm as the best sequences for targeting the human gene expression.

The dsRNA compounds disclosed herein are synthesized by any methods described herein, infra.

Tables 1-5 hereinbelow provide sequence pairs useful in generating double stranded nucleic acid molecules.

TABLE 1

Selected oligonucleotides useful in generating double-stranded nucleic acid compounds to target TLR2.

| name | SEQ ID NO: | SENSE 5'>3' | SEQ ID NO | ANTISENSE 5'>3' | Structure |
|---|---|---|---|---|---|
| TLR2_25 | 20607 | GGGUGGAGAACCUUAUGGU | 20614 | ACCAUAAGGUUCUCCACCC | A1 |
| TLR2_28 | 20608 | GGCAAGUGGAUCAUUGACA | 20615 | UGUCAAUGAUCCACUUGCC | A1 |
| TLR2_42 | 20609 | GGGUAAAUCUGAGAGCUGC | 20616 | GCAGCUCUCAGAUUUACCC | A1 |
| TLR2_43 | 20610 | CCAUUGAAAAGAGCCACAA | 20617 | UUGUGGCUCUUUUCAAUGG | A1 |
| TLR2_47 | 20611 | AUAAUGAACACCAAGACCU | 20618 | AGGUCUUGGUGUUCAUUAU | A1 |
| TLR2_31 | 20612 | GGUAAAUCUGAGAGCUGCA | 20619 | UGCAGCUCUCAGAUUUACC | A2 |
| TLR2_34 | 20613 | CUGGACUUCUCCCAUUUCA | 20620 | UGAAAUGGGAGAAGUCCAG | A2 |

TABLE 2

Selected oligonucleotides useful in generating double-stranded nucleic acid compounds to target TLR4.

| name | SEQ ID NO | SENSE 5'>3' | SEQ ID NO | ANTISENSE 5'>3' | Structure |
|---|---|---|---|---|---|
| TLR4_08 | 20621 | AACUUAAUGUGGCUCACAA | 20630 | UUGUGAGCCACAUUAAGUU | A1 |
| TLR4_10 | 20622 | GGCUGGCAAUUCUUUCCAA | 20631 | UUGGAAAGAAUUGCCAGCC | A1 |
| TLR4_11 | 20623 | GAUUUAUCCAGGUGUGAAA | 20632 | UUUCACACCUGGAUAAAUC | A1 |
| TLR4_14 | 20624 | CUCAAUCUCUCUUUAGACA | 20633 | UGUCUAAAGAGAGAUUGAG | A1 |
| TLR4_15 | 20625 | CGCUGGUGUAUCUUUGAAA | 20634 | UUUCAAAGAUACACCAGCG | A1 |
| TLR4_28 | 20626 | AAAAUGGCUGGCAAUUCUA | 20635 | UAGAAUUGCCAGCCAUUUU | A1 |
| TLR4_29 | 20627 | AGCCGCUGGUGUAUCUUUG | 20636 | CAAAGAUACACCAGCGGCU | A1 |
| TLR4_31 | 20628 | AAAUGGCUGGCAAUUCUUA | 20637 | UAAGAAUUGCCAGCCAUUU | A1 |
| TLR4_33 | 20629 | AUGGCUGGCAAUUCUUUCA | 20638 | UGAAAGAAUUGCCAGCCAU | A1 |

TABLE 3

Selected oligonucleotides useful in generating a double-stranded nucleic acid compound to target MYD88

| name | SEQ ID NO | SENSE 5'>3' | SEQ ID NO | ANTISENSE 5'>3' | Structure |
|---|---|---|---|---|---|
| MYD88_11 | 12178 | GAAUGUGACUUCCAGACCA | 12660 | UGGUCUGGAAGUCACAUUC | A1 |

TABLE 4

Selected oligonucleotides useful in generating double-stranded nucleic acid compounds to target TICAM1

| name | SEQ ID NO: | SENSE 5'>3' | SEQ ID NO | ANTISENSE 5'>3' | Structure |
|---|---|---|---|---|---|
| TICAM1_15 | 20639 | GGGUGAAGGGUCUUGGUGA | 20650 | UCACCAAGACCCUUCACCC | A2 |
| TICAM1_16 | 20640 | CUGGAAUCAUCAUCGGAAA | 20651 | UUUCCGAUGAUGAUUCCAG | A2 |
| TICAM1_17 | 20641 | GGACGAACACUCCCAGAUA | 20652 | UAUCUGGGAGUGUUCGUCC | A2 |
| TICAM1_18 | 20642 | GGCACUGAACGCAGCCUAA | 20653 | UUAGGCUGCGUUCAGUGCC | A2 |
| TICAM1_19 | 20643 | CCAGCAACUUGGAAAUCAA | 20654 | UUGAUUUCCAAGUUGCUGG | A2 |
| TICAM1_20 | 20644 | AGCCCUUCAUUUAGGACAA | 20655 | UUGUCCUAAAUGAAGGGCU | A1 |
| TICAM1_21 | 20645 | GGGUAUUGCUACGGUCUUA | 20656 | UAAGACCGUAGCAAUACCC | A2 |
| TICAM1_22 | 20646 | CCGGGAGCCCUUCAUUUAA | 20657 | UUAAAUGAAGGGCUCCCGG | A2 |
| TICAM1_23 | 20647 | GGCAGAAUGACCGCGUGUA | 20658 | UACACGCGGUCAUUCUGCC | A2 |
| TICAM1_24 | 20648 | GCGCCUUCGACAUUCUAGA | 20659 | UCUAGAAUGUCGAAGGCGC | A2 |
| TICAM1_25 | 20649 | CCUACUUCUCACCUCCAAA | 20660 | UUUGGAGGUGAGAAGUAGG | A2 |

TABLE 5

Selected oligonucleotides useful in generating double-stranded nucleic acid compounds to target TIRAP.

| name | SEQ ID NO: | SENSE 5>3' | SEQ ID NO | ANTISENSE 5'>3' | structure |
|---|---|---|---|---|---|
| TIRAP_16 | 20661 | CUAAGAAGCCUCUAGGCAA | 20673 | UUGCCUAGAGGCUUCUUAG | A1 |
| TIRAP_17 | 20662 | UAAGAAGCCUCUAGGCAAA | 20674 | UUUGCCUAGAGGCUUCUUA | A2 |
| TIRAP_18 | 20663 | GGAGCAAAGACUAUGACGA | 20675 | UCGUCAUAGUCUUUGCUCC | A2 |
| TIRAP_19 | 20664 | GCAAAGACUAUGACGUCUA | 20676 | UAGACGUCAUAGUCUUUGC | A2 |
| TIRAP_20 | 20665 | GGCGCUAUAGUGUCCGAGA | 20677 | UCUCGGACACUAUAGCGCC | A2 |
| TIRAP_21 | 20666 | GCCUCAGCUCAGUCACGUA | 20678 | UACGUGACUGAGCUGAGGC | A2 |
| TIRAP_22 | 20667 | CUAAGAAGCCUCUAGGCAU | 20679 | AUGCCUAGAGGCUUCUUAG | A2 |
| TIRAP_23 | 20668 | GCUUCACAGCCUACCUCAA | 20680 | UUGAGGUAGGCUGUGAAGC | A2 |
| TIRAP_24 | 20669 | UAAGAAGCCUCUAGGCAAU | 20681 | AUUGCCUAGAGGCUUCUUA | A2 |
| TIRAP_25 | 20670 | CAAAGAAGCUGUCAUGCGA | 20682 | UCGCAUGACAGCUUCUUUG | A2 |
| TIRAP_26 | 20671 | GGUGCAAGUACCAGAUGCA | 20683 | UGCAUCUGGUACUUGCACC | A2 |
| TIRAP_27 | 20672 | GCUCCGAUUCAUGUACUAA | 20684 | UUAGUACAUGAAUCGGAGC | A2 |

Table 6 hereinbelow provides a sequence code of the modified nucleotides/unconventional moieties utilized in preparing the dsRNA oligonucleotides according to Structure (A1)

| Name | Batch Number | Sense 5->3 | Antisense 5->3 |
|---|---|---|---|
| MYD88_1_S129 | 138977 | rU; rC; rG; rA; rU; rG; rC; rC; rU; rU; rC; rA; rU; rC; rU; rG; rC; LdT; rA$ | mU; rA; mG; rC; mA; rG; mA; rU; mG; rA; mA; rG; mG; rC; mA; rU; mC; rG; mA$ |
| MYD88_1_S505 | 138978 | rU; rC; rG; rA; rU; rG; rC; rC; rU; rU; rC; rA; rU; rC; rU; rG; rC; LdT; rA$ | rU; mA; rG; mC; mA; rG; rA; mU; rG; rA; mA; rG; mG; rC; mA; rU; mC; rG; mA$ |
| MYD88_11_S129 | 138983 | rG; rA; rA; rU; rG; rU; rG; rA; rC; rU; rU; rC; rC; rA; rG; rA; rC; LdC; rA$ | mU; rG; mG; rU; mC; rU; mG; rG; mA; rA; mG; rU; mC; rA; mC; rA; mU; rU; mC$ |
| MYD88_11_S505 | 138984 | rG; rA; rA; rU; rG; rU; rG; rA; rC; rU; rU; rC; rC; rA; rG; rA; rC; LdC; rA$ | rU; mG; rG; mU; rG; mC; rU; mG; rG; rA; rA; mG; rU; mC; rA; mC; rA; mU; rU; mC$ |
| MYD88_11_S870 | 60241388 | c6Np; rG; mA; rA; mU; rG; mU; rG; mA; rC; mU; rU; mC; rC; mA; rG; mA; rC; mC; rA$ | mU; rG; mG; rU; mC; rU; mG; rG; mA; rA; mG; rU; mC; rA; mC; rA; mU; rU; mC; dT; dT$ |
| MYD88_11_S871 | 60241391 | c6Np; rG; mA; rA; mU; rG; mU; rG; mA; rC; mU; mU; mC; dC; mA; rG; mA; dC; dC; rA$ | mU; rG; rG; dT; mC; dT; mG; rG; mA; rA; mG; dT; mC; rA; mC; rA; mU; dT; mC; dT; dT$ |
| MYD88_11_S872 | 60241394 | c6Np; rG; mA; rA; mU; rG; mU; rG; mA; rC; mU; rU; mC; dC; mA; rG; mA; dC; dC; dA$ | mU; rG; mG; rU; mC; rU; mG; rG; mA; rA; mG; rU; mC; rA; mC; rA; mU; rU; mC; dT; dT$ |
| MYD88_11_S873 | 60241397 | rG; mA; rA; mU; rG; mU; rG; mA; rC; mU; rU; mC; rC; mA; rG; rA; mC; dB; rA$ | mU; rG; mG; rU; mC; rU; mG; rG; mA; rA; mG; rU; mC; rA; mC; rA; mU; rU; mC; dT; dT$ |
| MYD88_11_S874 | 60241400 | rG; mA; rA; mU; rG; mU; rG; mA; rC; mU; rU; mC; rC; mA; rG; rA; mC; dB; rA$ | mU; rG; mG; dT; mC; dT; mG; rG; mA; rA; mG; dT; mC; rA; mC; rA; mU; rU; mC; dT; dT$ |
| MYD88_11_S971 |  | c6Np; rG; mA; rA; mU; rG; mU; rG; mA; dC; mU; mU; mC; dC; mA; rG; mA; dC; dC; rA$ | mU; rG; rG; dT; mC; dT; mG; rG; mA; rA; mG; dT; mC; rA; mC; rA; mU; dT; mC; dT; dT$ |
| MYD88_11_S972 |  | c6Np; rG; mA; rA; mU; rG; mU; rG; mA; dC; mU; dT; dC; dC; mA; rG; mA; dC; dC; dA$ | mU; rG; rG; mU; mC; mU; mG; rG; mA; rA; rG; mU; mC; rA; mC; rA; mU; mU; mC; dT; dT$ |
| MYD88_11_S973 |  | c6Np; rG; rA; rA; dT; rG; dT; rG; rA; dC; dT; dT; dC; dC; rA; rG; rA; dC; dC; rA$ | mU; rG; rG; dT; mC; dT; mG; rG; mA; rA; mG; dT; mC; rA; mC; rA; mU; dT; mC; dT; dT$ |
| MYD88_11_S974 |  | c6Np; rG; rA; rA; dT; rG; dT; rG; rA; dC; dT; dT; dC; dC; rA; rG; rA; dC; dC; rA$ | mU; rG; rG; mU; mC; mU; mG; rG; mA; rA; rG; mU; mC; rA; mC; rA; mU; mU; mC; dT; dT$ |
| TIRAP_1_S73 | 60258224 | rC; mC; rU; mG; rG; mU; rG; mC; rA; mA; rG; mU; rA; mC; rC; mA; rG; mA; rU$ | mA; rU; mC; rU; mG; rG; mU; rA; mC; rU; mU; rG; mC; rA; mC; rC; mA; rG; mG$ |
| TIRAP_2_S73 | 60258227 | rA; mG; rC; mU; rC; mC; rG; mA; rU; mU; rC; mA; rU; mG; rU; mA; rC; mU; rA$ | mU; rA; mG; rU; mA; rC; mA; rU; mG; rA; mA; rU; mC; rG; mG; rA; mG; rC; mU$ |
| TLR2_1_S710 | 60205154 | rG; rG; rU; rG; rC; rA; rA; rG; rU; rA; rU; rG; rA; rA; rC; rU; rG; rG; rA$ | rU; rC; rC; rA; rG; rU; rU; rC; rA; rU; rA; rC; rU; rU; rG; rC; rA; rC; rC$ |
| TLR2_1_S814_M1 | 140417 | idB; rG; rG; rU; rG; rC; rA; rA; rG; dT; rA; dT; rG; rA; rA; dC; rU; rG; LdG; rU$ | rA; mC; rC; mA; rG; mU; rU; mC; rA; rU; rA; mC; rU; mU; rG; mC; rA; mC; rC$ |
| TLR2_1_S815 | 140418 | idB; rG; rG; dT; rG; dC; rA; rA; rG; dT; mA; dT; rG; rA; rA; dC; mU; LdG; rG; rA$ | mU; mC; rC; rA; rG; mU; mU; mC; rA; rU; rA; mC; mU; mU; rG; mC; rA; mC; rC$ |
| TLR2_15_S73 | 60238659 | rG; mG; rG; mC; rA; mG; rU; mC; rU; mU; rG; mA; rA; mC; rA; mU; mU; rA$ | mU; rA; mA; rA; mU; rG; mU; rU; mC; rA; mA; rG; mA; rC; mU; rG; mC; rC; mC$ |
| TLR2_16_S73 | 60274507-60274508 | rG; mA; rG; mU; rG; mG; rU; mG; rC; mA; rA; mG; rU; mA; rU; mG; rA; mA; rC$ | mG; rU; mU; rC; mA; rU; mA; rC; mU; rU; mG; rC; mA; rC; mC; rA; mC; rU; mC$ |
| TLR2_16_S938 | 60274509-60274510 | rG; mA; rG; mU; rG; mG; rU; mG; rC; mA; rA; mG; rU; mA; rU; mG; rA; mA; rA$ | mU; rU; mU; rC; mA; rU; mA; rC; mU; rU; mG; rC; mA; rC; mC; rA; mC; rU; mC$ |
| TLR2_16_S939 | 60274509-60274508 | rG; mA; rG; mU; rG; mG; rU; mG; rC; mA; rA; mG; rU; mA; rU; mG; rA; mA; rA$ | mG; rU; mU; rC; mA; rU; mA; rC; mU; rU; mG; rC; mA; rC; mC; rA; mC; rU; mC$ |
| TLR2_16_S941 | 60274507-60274510 | rG; mA; rG; mU; rG; mG; rU; mG; rC; mA; rA; mG; rU; mA; rU; mG; rA; mA; rC$ | mU; rU; mU; rC; mA; rU; mA; rC; mU; rU; mG; rC; mA; rC; mC; rA; mC; rU; mC$ |

Table 7 hereinbelow provides a sequence code of the modified nucleotides/unconventional moieties utilized in preparing the dsRNA oligonucleotides according to Structure (A2)

| Name | Batch Numbers | Sense 5->3 | AntiSense 5->3 |
|---|---|---|---|
| MYD88_13_S73 | 60206348 | rG; mG; rA; mG; rA; mU; rG; mA; rU; mC; rC; mG; rG; mC; rA; mA; rC; mU; rA$ | mU; rA; mG; rU; mU; rG; mC; rC; mG; rG; mA; rU; mC; rA; mU; rC; mU; rC$ |
| MYD88_18_S73 | 60238315 | rG; mC; rC; mU; rA; mU; rC; mG; rC; mU; rG; mU; rU; mC; rU; mU; rG; mA; rA$ | mU; rU; mC; rA; mA; rG; mA; rA; mC; rA; mG; rC; mG; rA; mU; rA; mG; rG; mC$ |
| TIRAP_7_S73 | 60227223 | rC; mG; rG; mA; rA; mC; rU; mC; rC; mG; rA; mU; rU; mC; rA; mU; rG; mU; rA$ | mU; rA; mC; rA; mU; rG; mA; rA; mU; rC; mG; rG; mA; rG; mU; rU; mC; rC; mG$ |
| TIRAP_9_S73 | 60227229 | rG; mA; rU; mU; rC; mA; rU; mG; rU; mA; rC; mU; rA; mU; rG; mU; rG; mG; rA$ | mU; rC; mC; rA; mC; rA; mU; rA; mG; rU; mA; rC; mA; rU; mG; rA; mA; rU; mC$ |
| TIRAP_15_S73 | 60238354 | rC; mC; rA; mC; rA; mG; rU; mG; rA; mG; rG; mA; rG; mG; rA; mU; rU; mU; rA$ | mU; rA; mA; rA; mU; rC; mC; rU; mC; rC; mU; rC; mA; rC; mU; rG; mU; rG; mG$ |
| TLR2_3_S73 | 60205160 | rC; mG; rG; mG; rC; mA; rA; mA; rU; mG; rG; mA; rU; mC; rA; mU; rU; mG; rA$ | mU; rC; mA; rA; mU; rG; mA; rU; mC; rC; mA; rU; mU; rU; mG; rC; mC; rC; mG$ |
| TLR2_3_S818_M1 | 140422 | idB; rC; rG; rG; rG; rC; rA; rA; dT; rG; rG; rA; dT; rC; rA; rU; dT; rG; rU$ | rA; mC; rA; rA; mU; rG; rA; mU; rC; rC; rA; mU; rU; mU; rG; mC; rC; mC; rG$ |
| TLR4_1_S500 | 126174 | rG; mG; rC; mU; rG; mG; rC; mA; rA; mU; rU; mC; rU; mU; rU; mC; rA; mA; rA | mU; rU; mU; rG; mA; rA; mA; rG; mA; rA; mU; rU; mG; rC; mC; rA; mG; rC; mC |
| TLR4_3_S500 | 126176 | rG; mA; rU; mC; rU; mU; rG; mG; rG; mA; rG; mA; rA; mU; rU; mU; rA; mA; rA | mU; rU; mU; rA; mA; rA; mU; rU; mC; rU; mC; rC; mC; rA; mA; rG; mA; rU; mC |
| TLR4_5_S500 | 126178 | rG; mU; rU; mG; rG; mU; rG; mU; rA; mU; rC; mU; rU; mU; rG; mA; rA; mU; rA | mU; rA; mU; rU; mC; rA; mA; rA; mG; rA; mU; rA; mC; rA; mC; rC; mA; rA; mC |

TABLE 8

Code of the modified nucleotides/unconventional moieties

| Code | modification |
|---|---|
| c6Np | (5' cap) Amino-C6-Phosphate or Amino modifier C6 (Glen Research) |
| dA | deoxyriboadenosine-3'-phosphate |
| dB | abasic deoxyribose-3'-phosphate |
| dC | deoxyribocytidine-3'-phosphate |
| dG | deoxyriboguanosine-3'-phosphate |
| dT | thymidine-3'-phosphate |
| dT$ | thymidine (no phosphate) |
| iB | inverted deoxy-abasic |
| LdA | L-deoxyriboadenosine-3'-phosphate (mirror image dA) |
| LdA$ | L-deoxyriboadenosine (no phosphate) (mirror image dA) |
| LdC | L-deoxyribocyt0idine-3'-phosphate (mirror image dC) |
| LdC$ | L-deoxyribocytidine (no phosphate) (mirror image dC) |
| LdG | L-deoxyriboguanosine-3'-phosphate (mirror image dG) |
| LdT | L-deoxyribothymidine-3'-phosphate (mirror image dT) |
| LdT$ | L-deoxyribothymidine (no phosphate) (mirror image dT) |
| mA | 2'-O-methyladenosine-3'-phosphate |
| mA$ | 2'-O-methyladenosine (no phosphate) |
| mC | 2'-O-methylcytidine-3'-phosphate |
| mC$ | 2'-O-methylcytidine (no 3'-phosphate) |
| mG | 2'-O-methylguanosine-3'-phosphate |
| mG$ | 2'-O-methylguanosine (no phosphate) |
| mU | 2'-O-methyluridine-3'-phosphate |
| mU$ | 2'-O-methyluridine (no phosphate) |
| rA | riboadenosine-3'-phosphate |
| rA$ | riboadenosine (no phosphate) |
| rC | ribocytidine-3'-phosphate |
| rC$ | ribocytidine (no phosphate) |
| rG | riboguanosine-3'-phosphate |
| rU | ribouridine-3'-phosphate |
| rU$ | ribouridine (no phosphate) |

Example 2

RNAi Activity of Exemplary Double Stranded Oligonucleotide Compounds

Activity:

Single stranded oligonucleotides (sense strand and antisense strand) are synthesized using standard synthesis procedures. DMT-propane-Diol phosphoramidite ChemGenes; CLP-9908) is coupled at a concentration of 0.05M. Duplexes are generated by annealing complementary single stranded oligonucleotides. In a laminar flow hood, a 500 µM Stock Solution of single stranded oligonucleotide is prepared by diluting in WFI (water for injection, Norbrook). Actual ssRNA (single stranded) concentrations are determined by diluting each 500 µM ssRNA 1:200 using WFI, and measuring the OD using Nano Drop. The procedure is repeated 3 times and the average concentration is calculated. The Stock Solution was then diluted to a final concentration of 250 µM. Complementary single strands were annealed by heating to 85° C. and allowing to cool to room temperature over at least 45 minutes. Duplexes were tested for complete annealing by testing 5 µl on a 20% polyacrylamide gel and staining. Samples were stored at −80° C.

The double stranded nucleic acid molecules disclosed herein were tested for activity as follows: About 1.5-2×10$^5$ tested cells (HeLa cells and/or 293T cells for siRNA targeting human genes and NRK52 (normal rat kidney proximal tubule cells) cells and/or NMuMG cells (mouse mammary epithelial cell line) for siRNA targeting the rat/mouse gene) were seeded per well in 6 wells plate (70-80% confluent).

About 24 hours later, cells were transfected with modified siRNA compounds using the Lipofectamine™ 2000 reagent (Invitrogen) at final concentrations of from 0.001 nM to about 50 nM. The cells were incubated at 37° C. in a $CO_2$ incubator for 72 h.

As positive control for transfection PTEN-Cy3 labeled modified siRNA compounds are used. GFP siRNA compounds are used as negative control for siRNA activity.

At 72 h after transfection cells are harvested and RNA was extracted from cells. Transfection efficiency is tested by fluorescent microscopy.

The percent of inhibition of gene expression using specific preferred siRNA structures is determined using qPCR analysis of a target gene in cells expressing the endogenous gene.

Each sample is loaded onto a non-denaturing 20% acrylamide gel, prepared according to methods known in the art. The oligos are visualized with ethidium bromide under UV light.

In general, the dsRNAs having specific sequences that are selected for in vitro testing are specific for human and a second species such as rat or rabbit genes.

Stability to Exonucleases

To study the stabilization effect of 3' non-nucleotide moieties on a nucleic acid molecule the sense strand, the

TABLE 9

Activity of certain preferred TLR2 compounds

| Name | Sense sequence | Antisense sequence | Residual mRNA in Rat2 cells stable expressing human TLR2 20, 5, 0.5, 0.1 nM (repeat) |
|---|---|---|---|
| TLR2_31 | GGUAAAUCUGAGAGCUGCA | UGCAGCUCUCAGAUUUACC | 14, 7, 16 (10, 42, 86) |
| TLR2_42 | GGGUAAAUCUGAGAGCUGC | GCAGCUCUCAGAUUUACCC | 9, 14, 15, 37 (9, 25, 40) |
| TLR2_25 | GGGUGGAGAACCUUAUGGU | ACCAUAAGGUUCUCCACCC | 14, 17, 90, 54 (42, 84, 13, 29) |
| TLR2_28 | GGCAAGUGGAUCAUUGACA | UGUCAAUGAUCCACUUGCC | 24, 21, 30, 39 (12, 48, 64) |
| TLR2_34 | CUGGACUUCUCCCAUUUCA | UGAAAUGGGAGAAGUCCAG | 9, 28, 30, 28 (16, 37, 84) |
| TLR2_43 | CCAUUGAAAAGAGCCACAA | UUGUGGCUCUUUUCAAUGG | 34, 24, 18, 19 (6, 29, 46) |
| TLR2_47 | AUAAUGAACACCAAGACCU | AGGUCUUGGUGUUCAUUAU | 31, 35, 33, 37 (12, 43, 66) |

The IC50 value of the tested RNAi activity is determined by constructing a dose-response curve using the activity results obtained with the various final siRNA concentrations. The dose response curve is constructed by plotting the relative amount of residual target mRNA versus the logarithm of transfected siRNA concentration. The curve is calculated by fitting the best sigmoid curve to the measured data. The method for the sigmoid fit is also known as a 3-point curve fit.

$$Y = Bot + \frac{100 - Bot}{1 + 10^{(LogIC50 - X) \times HillSlope}}$$

where Y is the residual target mRNA response, X is the logarithm of transfected siRNA concentration, Bot is the Y value at the bottom plateau, Log IC50 is the X value when Y is halfway between bottom and top plateaus and HillSlope is the steepness of the curve.

Serum Stability

The double stranded nucleic acid molecules were tested for duplex stability in human serum or human tissue extract, as follows:

dsRNA molecules at final concentration of 7 uM are incubated at 37° C. in 100% human serum (Sigma Cat# H4522). (siRNA stock 100 uM diluted in human serum 1:14.29 or human tissue extract from various tissue types.). Five ul (5 ul) are added to 15 ul 1.5×TBE-loading buffer at different time points (for example 0, 30 min, 1 h, 3 h, 6 h, 8 h, 10 h, 16 h and 24 h). Samples are immediately frozen in liquid nitrogen and are kept at −20° C.

antisense strand and the annealed siRNA duplex are incubated in cytosolic extracts prepared from different cell types. A protocol for testing stability in HCT116 cells is provided below.

Extract: HCT116 cytosolic extract (12 mg/ml).

Extract buffer: 25 mM HEPES pH-7.3 at 37° C.; 8 mM MgCl; 150 mM NaCl with 1 mM DTT was added fresh immediately before use.

Method: 3.5 ml of test siRNA (100 mM), were mixed with 46.5 ml contain 120 mg of HCT116 cytosolic extract. The 46.5 ml consists of 12 ml of HCT116 extract, and 34.5 ml of the extract buffer supplemented with DTT and protease inhibitors cocktail/100 (Calbiochem, setIII-539134). The final concentration of the siRNA in the incubation tube is 7 mM. The sample is incubated at 37° C., and at the indicated time point 5 ml are moved to fresh tube, mixed with 15 ml of 1×TBE-50% Glycerol loading buffer, and snap frozen in Liquid N2. The final concentration of the siRNA in the loading buffer is about 1.75 mM (21 ng siRNA/ml). For analyses by native PAGE and EtBr staining 50 ng are loaded per lane. For Northern analyses 1 ng of tested siRNA is loaded per lane. Other cell types include HeLa and hepatic stellate cells (HSC).

The applicants have shown that nucleic acid molecules which include the 3' terminal alkyl; or alkyl derivative overhang exhibit enhanced stability compared to a blunt ended nucleic acid molecules and nucleic acid molecules comprising 3' nucleotide overhangs.

Example 3

Stability of Double Stranded RNA Molecules in Bronchoalveolar Lavage Fluid

Nuclease resistance of the dsRNA compounds disclosed herein is tested in human serum and/or in bronchoalveolar lavage fluid (BALF). For stability testing, a dsRNA compound is diluted in human serum or in bronchoalveolar lavage fluid (BALF) to a required final concentration (e.g. 7 µM). A 5 µL aliquot is transferred to 15 µL of 1.5×TBE-loading buffer, immediately frozen in liquid nitrogen, and transferred to −20° C. This represents "Time Point 0". The remaining dsRNA solution is divided into 5 µL aliquots, which are incubated at 37° C. for 30 min, 1 h, 6 h, 8 h, 10 h, 16 h or 24 h.

Following incubation, dsRNA compound samples are transferred to 15 µL of 1.5×TBE-loading buffer. 5 µL of each dsRNA compound in loading buffer sample is loaded onto a non denaturing 20% polyacrylamide gel and electrophoresis is performed. The positive control, double-strand migration reference (a non-relevant, 19-base pairs, blunt-ended, double-stranded RNA with similar chemical modifications), and single-strand migration reference (a non-relevant ssRNA with chemical modifications), as well as the Time Point 0 sample are loaded on the same gel and electrophoresed in parallel.

For dsRNA visualization the gel is stained with Ethidium bromide solution (1.0 µg/4).

Stability of dsRNA compounds disclosed herein is determined by examining the migration pattern of siRNA samples on PAGE following incubation in human serum and/or in bronchoalveolar lavage fluid (BALF).

Example 4

Efficacy of Therapeutic Activity of dsRNA Directed to TLR2 (SEQ ID NO 1): TLR4 (SEQ ID NO:2-4); MYD88 (SEQ ID NOS:5-9), TICAM1 (SEQ ID NO:10) and TIRAP (SEQ ID NOS:11-12) in Mouse Models of Orthotopic Vascularized Aerated Lung Transplantation Therapeutic efficacy of dsRNA compounds described herein in preventing primary graft dysfunction caused by both prolonged cold ischemia and immune rejection are tested in syngeneic and allogeneic mouse orthotopic models of lung transplantation. The method of orthotopic vascularized aerated left lung transplantation in the mouse utilizes cuff techniques for the anastomosis of pulmonary artery, pulmonary veins and bronchus. This method has been reported in several publications (Okazaki et al., Am J Transplant, 2007; 7:1672-9 and Krupnick et al. Nature Protocols, 2009; vol. 4 No. 1:86-93).

dsRNA test compounds: test compounds are preferably dsRNA having cross species specificity to human and mouse or human and rat mRNA target sequences. The sense and antisense sequences of dsRNA compounds that target TLR2 are set forth in SEQ ID NOS: 13-5846; the sense and antisense sequences of dsRNA compounds that target TLR4 are set forth in SEQ ID NOS: 5847-12144; The sense and antisense sequences of dsRNA compounds that target MYD88 are set forth in SEQ ID NOS: 12145-16332; The sense and antisense sequences of dsRNA compounds that target TICAM1 are set forth in SEQ ID NOS: 16333-18242; The sense and antisense sequences of dsRNA compounds that target TIRAP are set forth in SEQ ID NOS: 18243-20606. Certain preferred oligonucleotide pairs useful in generating double stranded nucleic acid molecules are set forth in Tables 1-5. The sense and/or antisense strands are preferably chemically modified as disclosed, supra.

Dosage and administration: dsRNA compounds are administered at the end of lung transplantation surgery (immediately after anastomosis opening), by intratracheal instillation to the recipient animal. The following doses of individual dsRNA compounds are tested in these animal models: 6 µg/mouse, 12.5 µg/mouse, 25 µg/mouse and 50 µg/mouse. Preferred double stranded nucleic acid molecules are generated using the sequences of the oligonucleotide pairs set forth in Tables 1-5.

Mouse Syngeneic Lung Transplantation (C57Bl/6→C57Bl/6)

Experimental design: Both donor and recipient are C57BL/6 mice. Prior to transplantation, ischemia reperfusion injury is induced by prolonged cold preservation of the lung transplant for 18 hours in cold storage in a low dextrose solution with components similar to solutions used to preserve human lung transplants (18 hours of cold ischemia time (CIT)). This method induces symptoms consistent with primary graft dysfunction 24 hours post-transplantation. Test dsRNA is administered into the trachea. Lung recipients are assessed 24 hours later for lung injury.

Administration: By intratracheal instillation of dsRNA solution to the lungs; 1 dose of a dsRNA compound or of a combination of dsRNA compounds is administered immediately after anastomosis opening on Day 0.

Evaluation: Lung recipients are evaluated at 24 hours post transplantation through assessing lung function, as measured by:

Gross pathology—appearance of pulmonary edema;
Pulmonary function—PaO2, oxygenation of arterial blood;
Intra-airway accumulation of cellular infiltrates; and
Total amount and differential counts of bronchoalveolar lavage (BAL) cells Results: In this syngeneic model, mouse isografts exposed to prolonged cold ischemia (18 hours CIT) develop impaired oxygenation, pulmonary edema, increased inflammatory cytokine production and intra-graft and intra-airway accumulation of granulocytes as measured 24 hours post-transplantation. By contrast, mouse lung recipients of 1 hour cold preserved grafts (1 hour CIT) show little evidence of lung injury 24 hours post-transplantation The test article (composition comprising a combination of TLR2 and TLR4 double stranded nucleic acid molecules; dsRNA specific for TLR2, dsRNA specific for TLR4 or vehicle) was administered immediately after opening of anastomosis and beginning of reperfusion. Preferred double stranded nucleic acid molecules are generated using the sequences of the oligonucleotide pairs set forth in Tables 1-5.

Example 5

Therapeutic activity of dsRNA directed to TLR2 (SEQ ID NO 1): TLR4 (SEQ ID NO:2-4); MYD88 (SEQ ID NOS:5-9), TICAM1 (SEQ ID NO:10) and TIRAP (SEQ ID NOS:11-12) in the Mouse Allogeneic Lung Transplantation (Balb/C→C57Bl/6)

Experimental design: In this model prolonged cold ischemia prevents lung allograft acceptance mediated by immunosuppression. In this model Balb/c lungs are subjected to 18 hours of cold ischemia time (CIT) and are transplanted into C57Bl/6 recipients that are treated with immunosuppressants: anti-CD40L on post operative day 0 and CTLA4Ig on day 2. In contrast to recipients who received allografts stored for 1 hour, these stored for 18 hours acutely rejected their allografts with marked intragraft accumulation of IFNγ+CD8+ T cells.

Evaluation: Lung recipients were evaluated at 7 days post transplantation through assessing:

Abundance of intragraft IFNγ+CD8+ T cells (by FACS)

Histopathological signs of acute graft rejection, A score

Administration: By intratracheal instillation of dsRNA solution to the lungs; 2 doses of a dsRNA compound or of a combination of dsRNA compounds are administered immediately after anastomosis opening on Day 0 and on Day 1 post Tx.

Example 6

Animal Models of Neuropathic Pain: Therapeutic Activity of dsRNA Directed to TLR2 (SEQ ID NO 1): TLR4 (SEQ ID NO:2-4); MYD88 (SEQ ID NOS:5-9), TICAM1 (SEQ ID NO:10) and TIRAP (SEQ ID NOS:11-12), in the Spinal Nerve Ligation Model (Chung) in Rats The Chung rat model (Kim and Chung, 1992. Pain. 1992 September; 50(3):355-63.) duplicates the symptoms of human patients with causalgia, or burning pain due to injury of a peripheral nerve. The Chung procedure produces a long-lasting hyperalgesia to noxious heat and mechanical allodynia of the affected foot. Rats with spinal nerve ligation (SNL) are useful for identifying active dsRNA compounds for use in alleviating neuropathic pain. Preferred dsNA molecules are generated using the sequences of the oligonucleotide pairs set forth in Tables 1-5.

Alleviation Of Neuropathic Pain in Chung Model Rats: The Chung model is performed on male Sprague-Dawley rats weighing 190 to 210 grams to induce an allodynic state. Animals are acclimated for at least 5 days. During acclimation and throughout the entire study duration, animals are housed within a limited access rodent facility and kept in groups with a maximum of 5 rats per cage. Animals are provided ad libitum with a commercial rodent diet and have free access to drinking water. Automatically controlled environmental conditions were monitored daily. Animals are given a unique animal identification tail mark.

During the acclimation period, animals are randomly assigned to experimental groups. Each dosing group is kept in separate cages to avoid cross-contamination which can occur through consumption of fecal matter. 2-3 animals will be housed per cage.

Briefly, the rats are anesthetized with ketamine/xylazine sodium and subsequently, the left L-5 and L-6 spinal nerves is isolated adjacent to the vertebral column and ligated. The muscle is sutured and the skin closed with a clamp. Seven days day postoperative recovery period, the animals are tested for inclusion into the study. Pain is detected when one or more of the criteria below are met:

Licking of the operated paw, accompanied by gentle biting or pulling nails with the mouth; lifting the operated leg in the air; bearing weight on the side contralateral to the nerve injury; deformities of the hind paw and abnormal walking; weakness of the left hind paw. The animal has to be able to move it leg to ensure that L4 is intact.

Alzet pump: Animals from some groups are implanted subcutaneously with osmotic pumps on the day of surgery. A polyethylene tubing is implanted in the intrathecal space of the spinal cord, ending at level L4 and a cannula was connected to the pump.

Lumbar injections: Animals from some groups are given bolus lumber injections as follows: An intrathecal tube was inserted into the animals IT space at L4-L5 level and the test agents were dosed slowly.

It will be readily apparent to one skilled in the art that substitutions and modifications can be made to the molecules, compositions and methods disclosed herein without departing from the scope and spirit of the invention. Thus, such additional embodiments are within the scope of the disclosure and the following claims. The present disclosures teach one skilled in the art various combinations of oligonucleotides and chemical modifications described herein toward generating therapeutically effective double stranded nucleic acid molecules to down regulate expression of TLR2, TLR4, MYD88, TICAM1 and TIRAP. The therapeutically effective double stranded nucleic acid molecules exhibit one or more of stability in biological fluids, bioavailability, high on target activity, low off target activity. Therefore, the specific embodiments described herein are not limiting and one skilled in the art can readily appreciate that additional specific combinations can be tested without undue experimentation toward identifying therapeutic combinations with improved activity.

The terms "comprising", "having," "including," containing", etc. shall be read expansively and without limitation (e.g., meaning "including, but not limited to,"). Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the invention claimed.

The disclosure has been described broadly and generically herein. Each of the narrower species and sub-generic groupings falling within the generic disclosure also form part of the invention. This includes the generic description of the invention with a proviso or negative limitation removing any subject matter from the genus, regardless of whether or not the excised material is specifically recited herein. Other embodiments are within the following claims. In addition, where features or aspects of the invention are described in terms of Markush groups, those skilled in the art will recognize that the invention is also thereby described in terms of any individual member or subgroup of members of the Markush group.

Throughout this application various patents and publications are cited. The disclosures of these documents in their entireties are hereby incorporated by reference into this application to more fully describe the state of the art to which this invention pertains.

Although the above examples have illustrated particular ways of carrying out embodiments, in practice persons skilled in the art will appreciate alternative ways of carrying out embodiments, which are not shown explicitly herein. It should be understood that the present disclosure is to be considered as an exemplification of the principles of this invention and is not intended to limit the invention to the embodiments illustrated.

Those skilled in the art will recognize, or be able to ascertain using no more than routine experimentation, equivalents of the specific embodiments of the invention described herein. Such equivalents are intended to be encompassed by the following claims.

SEQUENCE LISTING (20684 sequences)

SEQ ID NO: 1 - RNA, 3417 nt, Homo_Sapiens
cggaggcagcgagaaagcgcagccaggcggcugcucggcguucucucaggugacugcucggaguucucccaguguuugguguugcaagcaggauccaaaggagaccuauagugacucccaggagcucuuagugaccaagugaagguaccuguggggcucauugugcccauugcucuuucacugcuuucaacugguaguuguggguugaagcacuggacaaugccacauacuuuguggauggugugggucuugggggucaucaucagccucuccaaggaagaauccuccaaucaggcuucucugucuugugaccgcaaugguaucugcaagggcagcucaggaucuuuaaacuccauucccucagggcucacagaagcuguaaaaagccuugaccuguccaacaacaggaucaccuacauuagcaacagugaccuacagaggugugugaaccuccaggcucuggugcugacauccaauggaauuaacacaauagaggaagauucuuuuucuucccugggcagucuugaacauuuagacuuauccuauaauuacuuaucuaauuuaucgucuuccugguucaagccccuuucuucuuuaacauucuuaaacuuacugggaaauccuuacaaaacccuaggggaaacaucucuuuuuucucaucucacaaaauugcaaauccugagagugggaaauauggacaccuucacuaagauucaaagaaaagauuuugcuggacuuaccuuccuugaggaacuugagauugaugcuucagaucuacagagcuaugagccaaaaaguuugaagucaauucagaauguaagucaucugauccuucauaugaagcagcauauuuuacugcuggagauuuuuguagauguuacaaguuccguggaauguuuggaacugcgagauacugauuuggacacuuuccauuuuucagaacuauccacuggugaaacaaauucauugauuaaaaaguuuacauuuagaaaugugaaaaucaccgaugaaaguuuguuucagguuaugaaacuuuugaaucagauuucuggauuguuagaauuagaguuugaugacuguacccuuaauggaguugguaauuuuagagcaucugauaaugacagaguuauagauccagguaaaguggaaacguuaacaauccggaggcugcauauuccaagguuuuacuuauuuuaugaucugagcacuuuauauucacuuacagaaagaguuaaaagaaucacaguagaaaacaguaaaguuuuucugguuccuuguuuacuuucacaacauuuaaaaucauuagaauacuuggaucucagugaaaauuugaugguugaagaauacuugaaaaauucagccugugaggaugccuggcccucucuacaaacuuuaauuuuaaggcaaaaucauuuggcaucauuggaaaaaaccggagagacuuugcucacucugaaaaacuugacuaacauugauaucaguaagaauaguuuucauucuaugccugaaacuugucaguggccagaaaagaugaaauauuugaacuuauccagcacacgaauacacaguguaacaggcugcauucccaagacacuggaaauuuuagauguuagcaacaacaaucucaauuuauuuucuuugaauuugccgcaacucaaagaacuuuauauuuccagaaauaaguugaugacucuaccagaugccucccucuuacccauguuacuaguauugaaaaucaguaggaaugcaauaacuacguuuucuaaggagcaacuugacucauuucacacacugaagacuuuggaagcugguggcaauaacuucauuugcuccugugaauuccucuccuucacucaggagcagcaagcacuggccaaagucuugauugauuggccagcaaauuaccugugugacucuccaucccaugugcguggccagcagguucaggauguccgccucucggugucggaaugucacaggacagcacuggugucuggcaugugcugugcucuguuccugcugauccugcucacggggguccugugccaccguuuccauggccugugguauaugaaaaugaugugggccuggcuccaggccaaaaggaagcccaggaaagcucccagcaggaacaucugcuaugaugcauuuguuucuuacagugagcgggaugccuacuggguggagaaccuuaugguccaggagcuggagaacuucaauccccccuucaaguugugucuucauaagcgggacuucauuccuggcaaguggaucauugacaauaucauugacuccauugaaaagagccacaaaacugucuuugugcuuucugaaaacuuugugaagagugaguggugcaaguaugaacuggacuucucccauuuccgucuuuuugaugagaacaaugaugcugccauucucauucuucuggagcccauugagaaaaaagccauuccccagcgcuucugcaagcugcggaagauaaugaacaccaagaccuaccuggaguggcccauggacgaggcucagcgggaaggauuuuggguaaaucugagagcugcgauaaaguccuagguucccauauuuaagaccagucuuugucuaguugggaucuuuaugucacuaguuauaguuaaguucauucagacauaauuauauaaaaacuacguggauguaccgucauuugaggacuugcuuacuaaaacuacaaaacuucaaauuuugucuggggugcuguuuuauaaacauaugccagauuuaaaaauugguuuuugguuuuucuuuuuucuaugagauaaccaugaucauaagucuauuacugauaucugaauauagucccuugguauccaagggaauugguugcaggauccucguggauaucaaaauucauagaugaucaagucccuuauaagaguggcauaguauuugcauauaaccuguguacauucuccuguauacuuuaaaucaucucuagauuacuuaugauacccaauacaauguaaauacuauguaaauaguuguacugucuuuuuauuuauauuauuauuguuauuuuuuauuuucaaaauuuuuaaaacauacuuuugauccacaguugguugacuucauggaugcagaacccauggauauagagggccaacuguaaucuguagcaacuggcuuaguucauuaggaaacagcacaaaugaacuuaagauucucaaugacugugucauucuuucuuccugcuaagagacuccucuguggccacaaaaggcauucucuguccuaccuagcugucacuucucugugcagcugaucucaagagcaacaaggcaaaguauuuggggcacuccccaaaacuuguugcuauuccuagaaaaaagugcuguguauuuccuauuaaacuuuacaggaugagaaaaaaaaaaaaaaaaa

SEQ ID NO: 2 - RNA, 5667 nt, Homo_Sapiens
cucuugcuguuucuuuagccacuggucugcaggcguuuucuucuucuaacuuccucuccugugacaaaagagauaacuauuagagaaacaaaaguccagaaugcuaagguugccgcuuucacuuccucucacccuuuagcccagaacugcuuugaauacaccaauugcuguggggcggcucgaggaagagaagacaccagugccucagaaacugcucggucagacggugauagcgagccacgcauucacagggccacugcugcucacagaagcagugaggaugaugccaggaugaugucugccucgcgccuggcugggacucugaucccagccauggccuuccucuccugcgugagaccagaaagcugggagcccugcguggaggugguuccuaauauuacuuaucaaugcauggagcugaauuucuacaaaauccccgacaaccuccccuucucaaccaagaaccuggaccugagcuuuaauccccugaggcauuuaggcagcuauagcuucuucaguuucccagaacugcaggugcuggauuuauccaggugugaaauccagacaauugaagauggggcauaucagagccuaagccaccucucuaccuuaauauugacaggaaaccccauccagaguuuagcccugggagccuuuucuggacuaucaaguuuacagaagcugguggcuguggagacaaaucuagcaucucuagagaacuuccccauuggacaucucaaaacuuugaaagaacuuaauguggcucacaaucuuauccaaucuuucaaauuaccugaguauuuuucuaaucugaccaaucuagagcacuuggaccuuuccagcaacaagauucaaaguauuuauugcacagacuugcggguucuacaucaaaugccccuacucaaucucucuuuagaccugucccugaacccuaugaacuuuauccaaccaggugcauuuaaagaaauuaggcuucauaagcugacuuuaagaaauaauuuugauaguuuaaauguaaugaaaacuuguauucaaggucuggcugguuuagaaguccaucguuugguucugggagaauuuagaaaugaaggaaacuuggaaaaguuugacaaaucugcucuagagggccugugcaauuugaccauugaagaauuccgauuagcauacuuagacuacuaccucgaugauauuauugacuuauuuaauuguuugacaaauguuucuucauuuucccuggugagugugacuauugaaaggguaaaagacuuuucuuauaauuucggauggcaacauuuagaauuaguuaacuguaaauuuggacaguuucccacauugaaacucaaaucucucaaaaggcuuacuuucacuuccaacaaaggugggaaugcuuuuucagaaguugaucuaccaagccuugaguuucuagaucucaguagaaauggcuugaguuucaaagguugcuguucucaaagugauuuugggacaaccagccuaaaguauuuagaucugagcuucaaugguguuauuaccaugaguucaaacuucuugggcuuagaacaacuagaacaucuggauuuccagcauuccaauuugaaacaaaugagugaguuuucaguauuccuaucacucagaaaccucauuuaccuugacauuucucauacucacaccagaguugcuuucaauggcaucuucaauggcuuguccagucucgaagucuugaaaauggcuggcaauucuuuccaggaaaacuuccuuccagauaucuucacagagcugagaaacuugaccuuccuggaccucucucagugucaacuggagcaguugucuccaacagcauuuaacucacucuccagucuucagguacuaaauaugagccacaacaacuucuuuucauuggauacguuuccuuauaagugucugaacucccuccagguucuugauuacagucucaaucacauaaugacuuccaaaaaacaggaacuacagcauuuuccaaguagucuagcuuucuuaaaucuuacucagaaugacuuugcuuguacuugugaacaccagaguuuccugcaauggaucaaggaccagaggcagcucuugguggaaguugaacgaauggaaugugcaacaccuucagauaagcagggcaugccugugcugaguuugaauaucaccugucagaugaauaagaccaucauuggugugucgguccucagugugcuuguaguaucuguuguagcaguucuggucuauaaguucuauuuucaccugaugcuucuugcuggcugcauaaaguaugguagaggugaaaacaucuaugaugccuuuguuaucuacucaagccaggaugaggacuggguaaggaaugagcuaguaaagaauuuagaagaaggggugccuccauuucagcucugccuucacuacagagacuuuauucccgguguggccauugcugccaacaucauccaugaagguuuccauaaaagccgaaaggugauuguuguggugucccagcacuucauccagagccgcugguguaucuuugaauaugagauugcucagaccuggcaguuucugagcagucgugcugguaucaucuucauuguccugcagaagguggagaagacccugcucaggcagcagguggagcuguaccgccuucucagcaggaacacuuaccuggagugggaggacaguguccuggggcggcacaucuucuggagacgacucagaaaagcccugcuggaugguaaaucauggaauccagaaggaacaguggguacaggaugcaauuggcaggaagcaacaucuaucugaagaggaaaaauaaaaaccuccugaggcauuucuugcccagcuggguccaacacuuguucaguuaauaaguauuaaaugcugccacaugucaggccuuaugcuaagggugaguaauuccauggugcacuagauaugcagggcugcuaaucucaaggagcuuccagugcagagggaauaaaugcuagacuaaaauacagagucuuccaggugggcauuucaaccaacucagucaaggaacccaugacaaagaaagucauuucaacucuuaccucaucaaguugaauaaagacagagaaaacagaaagagacauuguucuuuuccugagucuuuugaauggaaauuguauuauguuauagccaucauaaaaccauuuugguaguuuugacugaacuggguguucacuuuuuccuuuuugauugaauacaauuuaaauucuacuugaugacugcagucgucaaggggcuccugaugcaagaugccccuuccauuuuaagucugucuccuuacagagguuaaagucuaguggcuaauuccuaaggaaaccugauuaacacaugcucacaaccauccuggucauucucgagcauguucuauuuuuuaacuaaucaccccugauauauuuuuauuuuuauauauccaguuuucauuuuuuuacgucuugccuauaagcuaauaucauaaauaagguuguuuaagacgugcuucaaauauccauauuaaccacuauuuuucaaggaaguauggaaaaguacacucugucacuuugucacucgaugucauuccaaaguuauugccuacuaaguaaugacugucaugaaagcagcauugaaauaauuuguuuaaagggggcacucuuuuaaacgggaagaaaauuuccgcuuccuggucuuaucauggacaauuugggcuagaggcaggaaggaagugggaugaccucaggaggucaccuuuucuugauuccagaaacauaugggcugauaaacccggggugaccucaugaaaugaguugcagcagaaguuuauuuuuuucagaacaagugauguuugauggaccucugaaucucuuuagggagacacagauggcugggaucccuccccuguacccuucucacugccaggagaacuacgugugaagguauucaaggcagggaguauacauugcuguuuccuguugggcaaugcuccuugaccacauuuugggaagaguggauguuaucauugagaaaacaaugugucuggaauuaaugggguucuuauaaagaagguucccagaaaagaauguucauccagccuccucagaaacagaacauucaagaaaaggacaaucaggaugucaucagggaaaugaaaauaaaaaccacaaugagauaucaccuuauaccagguagaauggcuacuauaaaaaaaugaagugucaucaaggauauagagaaauuggaacccuucuucacugcuggagggaauggaaaaugguguagccguuaugaaaaacaguacggagguuucucaaaaauuaaaaauagaacugcuauaugauccagcaaucucacuucuguauauauacccaaaauaauugaaaucagaauuucaagaaaauauuuacacucccauguucauuguggcacucuucacaaucacuguuuccaaaguuauggaaacaacccaaauuuccauugaaaaauaaauggacaaagaaaaugugcauauacguacaaugggauauuauucagccuaaaaaaagggggaauccuguuauuuaugacaacaugaauaaacccggaggccauuaugcuauguaaaaugagcaaguaacagaaagacaaauacugccugauuucauuuauaugagguucuaaaauagucaaacucauagaagcagagaauagaacagugguuccuagggaaaaggaggaagggagaaaugaggaaauagggaguugucuaauugguauaaaauuauaguaugcaagaugaauuagcucuaaagaucagcuguauagcagaguucguauaaugaacaauacuguauuaugcacuuaacauuuuguuaagaggguaccucucauguuaaguguucuuaccauauacauauacacaaggaagcuuuuggaggugauggauauauuuauuaccuugauuguggugaugguuugacagguaugugacuaugucuaaacucaucaaauuguauacauuaaauauaugcaguuuuauaauaucaauuaugucugaaugaagcuauaaaaaagaaaagacaacaaaauucaguugucaaaacuggaaauaugaccacagucagaaguguuuguuacugaguguuucagaguguguuugguuugagcaggucuagggugauugaacaucccuggguguguuuccaugucucauguacuagugaaaguagaugugugcauuugugcacauaucccuauguaucccuaucagggcuguguguauuugaaaguguguguguccgcaugaucauaucuguauagaagagagugugauuauauuucuugaagaauacauccauuugaaauggaugucuauggcuguuugagaugaguucucuacucuugugcuuguacaguagucuccccuuaucccuuaugcuugguggauacguucuuagaccccaaguggaucucugagaccgcagaugguaccaaaccucauauaugcaauauuuuuuccuauacauaaauaccuaagauaaaguucaucuucugaauuaggcacaguaagagauuaacaauaacuaacaauaaaauugaauaguuauaauaauauauuguaauaaaaguuaugugaaugugaucucuuucuuucucucucucaaaaaaaaaaaaaaaaaa

SEQ ID NO: 3 - RNA, 5787 nt, Homo_Sapiens
cucuugcuguuucuuuagccacuggucugcaggcguuuucuucuucuaacuuccucuccugugacaaaagagauaacuauuagagaaacaaaaguccagaaugcuaagguugccgcuuucacuuccucucacccuuuagcccagaacugcuuugaauacaccaauugcuguggggcggcucgaggaagagaagacaccagugccucagaaacugcucggucagacggugauagcgagccacgcauucacagggccacugcugcucacagaagcagugaggaugaugccaggaugaugucugccucgcgccuggcugggacucugaucccagccauggccuuccucuccugcgugagaccagaaagcugggagcccugcguggagacuuggcccuaaaccacacagaagagcuggcaugaaacccagagcuuucagacuccggagccucagcccuucaccccgauuccauugcuucuugcuaaaugcugccguuuuaucacggaggugguuccuaauauuacuuaucaaugcauggagcugaauuucuacaaaauccccgacaaccuccccuucucaaccaagaaccuggaccugagcuuuaauccccugaggcauuuaggcagcuauagcuucuucaguuucccagaacugcaggugcuggauuuauccaggugugaaauccagacaauugaagauggggcauaucagagccuaagccaccucucuaccuuaauauugacaggaaaccccauccagaguuuagcccugggagccuuuucuggacuaucaaguuuacagaagcugguggcuguggagacaaaucuagcaucucuagagaacuuccccauuggacaucucaaaacuuugaaagaacuuaauguggcucacaaucuuauccaaucuuucaaauuaccugaguauuuuucuaaucugaccaaucuagagcacuuggaccuuuccagcaacaagauucaaaguauuuauugcacagacuugcggguucuacaucaaaugccccuacucaaucucucuuuagaccugucccugaacccuaugaacuuuauccaaccaggugcauuuaaagaaauuaggcuucauaagcugacuuuaagaaauaauuuugauaguuuaaauguaaugaaaacuuguauucaaggucuggcugguuuagaaguccaucguuugguucugggagaauuuagaaaugaaggaaacuuggaaaaguuugacaaaucugcucuagagggccugugcaauuugaccauugaagaauuccgauuagcauacuuagacuacuaccucgaugauauuauugacuuauuuaauuguuugacaaauguuucuucauuuucccuggugagugugacuauugaaaggguaaaagacuuuucuuauaauuucggauggcaacauuuagaauuaguuaacuguaaauuuggacaguuucccacauugaaacucaaaucucucaaaaggcuuacuuucacuuccaacaaaggugggaaugcuuuuucagaaguugaucuaccaagccuugaguuucuagaucucaguagaaauggcuugaguuucaaagguugcuguucucaaagugauuuugggacaaccagccuaaaguauuuagaucugagcuucaaugguguuauuaccaugaguucaaacuucuugggcuuagaacaacuagaacaucuggauuuccagcauuccaauuugaaacaaaugagugaguuuucaguauuccuaucacucagaaaccucauuuaccuugacauuucucauacucacaccagaguugcuuucaauggcaucuucaauggcuuguccagucucgaagucuugaaaauggcuggcaauucuuuccaggaaaacuuccuuccagauaucuucacagagcugagaaacuugaccuuccuggaccucucucagugucaacuggagcaguugucuccaacagcauuuaacucacucuccagucuucagguacuaaauaugagccacaacaacuucuuuucauuggauacguuuccuuauaagugucugaacucccuccagguucuugauuacagucucaaucacauaaugacuuccaaaaaacaggaacuacagcauuuuccaaguagucuagcuuucuuaaaucuuacucagaaugacuuugcuuguacuugugaacaccagaguuuccugcaauggaucaaggaccagaggcagcucuugguggaaguugaacgaauggaaugugcaacaccuucagauaagcagggcaugccugugcugaguuugaauaucaccugucagaugaauaagaccaucauuggugugucgguccucagugugcuuguaguaucuguuguagcaguucuggucuauaaguucuauuuucaccugaugcuucuugcuggcugcauaaaguaugguagaggugaaaacaucuaugaugccuuuguuaucuacucaagccaggaugaggacuggguaaggaaugagcuaguaaagaauuuagaagaaggggugccuccauuucagcucugccuucacuacagagacuuuauucccgguguggccauugcugccaacaucauccaugaagguuuccauaaaagccgaaaggugauuguuguggugucccagcacuucauccagagccgcugguguaucuuugaauaugagauugcucagaccuggcaguuucugagcagucgugcugguaucaucuucauuguccugcagaagguggagaagacccugcucaggcagcagguggagcuguaccgccuucucagcaggaacacuuaccuggagugggaggacaguguccuggggcggcacaucuucuggagacgacucagaaaagcccugcuggaugguaaaucauggaauccagaaggaacaguggguacaggaugcaauuggcaggaagcaacaucuaucugaagaggaaaaauaaaaaccuccugaggcauuucuugcccagcuggguccaacacuuguucaguuaauaaguauuaaaugcugccacaugucaggccuuaugcuaagggugaguaauuccauggugcacuagauaugcagggcugcuaaucucaaggagcuuccagugcagagggaauaaaugcuagacuaaaauacagagucuuccaggugggcauuucaaccaacucagucaaggaacccaugacaaagaaagucauuucaacucuuaccucaucaaguugaauaaagacagagaaaacagaaagagacauuguucuuuuccugagucuuuugaauggaaauuguauuauguuauagccaucauaaaaccauuuugguaguuuugacugaacuggguguucacuuuuuccuuuuugauugaauacaauuuaaauucuacuugaugacugcagucgucaaggggcuccugaugcaagaugccccuuccauuuuaagucugucuccuuacagagguuaaagucuaguggcuaauuccuaaggaaaccugauuaacacaugcucacaaccauccuggucauucucgagcauguucuauuuuuuaacuaaucaccccugauauauuuuuauuuuuauauauccaguuuucauuuuuuuacgucuugccuauaagcuaauaucauaaauaagguuguuuaagacgugcuucaaauauccauauuaaccacuauuuuucaaggaaguauggaaaaguacacucugucacuuugucacucgaugucauuccaaaguuauugccuacuaaguaaugacugucaugaaagcagcauugaaauaauuuguuuaaagggggcacucuuuuaaacgggaagaaaauuuccgcuuccuggucuuaucauggacaauuugggcuagaggcaggaaggaagugggaugaccucaggaggucaccuuuucuugauuccagaaacauaugggcugauaaacccggggugaccucaugaaaugaguugcagcagaaguuuauuuuuuucagaacaagugauguuugauggaccucugaaucucuuuagggagacacagauggcugggaucccuccccuguacccuucucacugccaggagaacuacgugugaagguauucaaggcagggaguauacauugcuguuuccuguugggcaaugcuccuugaccacauuuugggaagaguggauguuaucauugagaaaacaaugugucuggaauuaaugggguucuuauaaagaagguucccagaaaagaauguucauccagccuccucagaaacagaacauucaagaaaaggacaaucaggaugucaucagggaaaugaaaauaaaaaccacaaugagauaucaccuuauaccagguagaauggcuacuauaaaaaaaugaagugucaucaaggauauagagaaauuggaacccuucuucacugcuggagggaauggaaaaugguguagccguuaugaaaaacaguacggagguuucucaaaaauuaaaaauagaacugcuauaugauccagcaaucucacuucuguauauauacccaaaauaauugaaaucagaauuucaagaaaauauuuacacucccauguucauuguggcacucuucacaaucacuguuuccaaaguuauggaaacaacccaaauuuccauugaaaaauaaauggacaaagaaaaugugcauauacguacaaugggauauuauucagccuaaaaaaagggggaauccuguuauuuaugacaacaugaauaaacccggaggccauuaugcuauguaaaaugagcaaguaacagaaagacaaauacugccugauuucauuuauaugagguucuaaaauagucaaacucauagaagcagagaauagaacagugguuccuagggaaaaggaggaagggagaaaugaggaaauagggaguugucuaauugguauaaaauuauaguaugcaagaugaauuagcucuaaagaucagcuguauagcagaguucguauaaugaacaauacuguauuaugcacuuaacauuuuguuaagaggguaccucucauguuaaguguucuuaccauauacauauacacaaggaagcuuuuggaggugauggauauauuuauuaccuugauuguggugaugguuugacagguaugugacuaugucuaaacucaucaaauuguauacauuaaauauaugcaguuuuauaauaucaauuaugucugaaugaagcuauaaaaaagaaaagacaacaaaauucaguugucaaaacuggaaauaugaccacagucagaaguguuuguuacugaguguuucagaguguguuugguuugagcaggucuagggugauugaacaucccuggguguguuuccaugucucauguacuagugaaaguagaugugugcauuugugcacauaucccuauguaucccuaucagggcuguguguauuugaaaguguguguguccgcaugaucauaucuguauagaagagagugugauuauauuucuugaagaauacauccauuugaaauggaugucuauggcuguuugagaugaguucucuacucuugugcuuguacaguagucuccccuuaucccuuaugcuugguggauacguucuuagaccccaaguggaucucugagaccgcagaugguaccaaaccucauauaugcaauauuuuuuccuauacauaaauaccuaagauaaaguucaucuucugaauuaggcacaguaagagauuaacaauaacuaacaauaaaauugaauaguuauaauaauauauuguaauaaaaguuaugugaaugugaucucuuucuuucucucucucaaaaaaaaaaaaaaaaaa

SEQ ID NO: 4 - RNA, 5500 nt, Homo_Sapiens
cucuugcuguuucuuuagccacuggucugcaggcguuuucuucuucuaacuuccucuccugugacaaaagagauaacuauuagagaaacaaaaguccagaaugcuaagguugccgcuuucacuuccucucacccuuuagcccagaacugcuuugaauacaccaauugcuguggggcggcucgaggaagagaagacaccagugccucagaaacugcucggucagacggugauagcgagccacgcauucacagggccacugcugcucacagaagcagugaggaugaugccaggaugaugucugccucgcgccuggcugggacucugaucccagccauggccuuccucuccugcgugagaccagaaagcugggagcccugcguggaggugugaaauccagacaauugaagauggggcauaucagagccuaagccaccucucuaccuuaauauugacaggaaaccccauccagaguuuagcccugggagccuuuucuggacuaucaaguuuacagaagcugguggcuguggagacaaaucuagcaucucuagagaacuuccccauuggacaucucaaaacuuugaaagaacuuaauguggcucacaaucuuauccaaucuuucaaauuaccugaguauuuuucuaaucugaccaaucuagagcacuuggaccuuuccagcaacaagauucaaaguauuuauugcacagacuugcggguucuacaucaaaugccccuacucaaucucucuuuagaccugucccugaacccuaugaacuuuauccaaccaggugcauuuaaagaaauuaggcuucauaagcugacuuuaagaaauaauuuugauaguuuaaauguaaugaaaacuuguauucaaggucuggcugguuuagaaguccaucguuugguucugggagaauuuagaaaugaaggaaacuuggaaaaguuugacaaaucugcucuagagggccugugcaauuugaccauugaagaauuccgauuagcauacuuagacuacuaccucgaugauauuauugacuuauuuaauuguuugacaaauguuucuucauuuucccuggugagugugacuauugaaaggguaaaagacuuuucuuauaauuucggauggcaacauuuagaauuaguuaacuguaaauuuggacaguuucccacauugaaacucaaaucucucaaaaggcuuacuuucacuuccaacaaaggugggaaugcuuuuucagaaguugaucuaccaagccuugaguuucuagaucucaguagaaauggcuugaguuucaaagguugcuguucucaaagugauuuugggacaaccagccuaaaguauuuagaucugagcuucaaugguguuauuaccaugaguucaaacuucuugggcuuagaacaacuagaacaucuggauuuccagcauuccaauuugaaacaaaugagugaguuuucaguauuccuaucacucagaaaccucauuuaccuugacauuucucauacucacaccagaguugcuuucaauggcaucuucaauggcuuguccagucucgaagucuugaaaauggcuggcaauucuuuccaggaaaacuuccuuccagauaucuucacagagcugagaaacuugaccuuccuggaccucucucagugucaacuggagcaguugucuccaacagcauuuaacucacucuccagucuucagguacuaaauaugagccacaacaacuucuuuucauuggauacguuuccuuauaagugucugaacucccuccagguucuugauuacagucucaaucacauaaugacuuccaaaaaacaggaacuacagcauuuuccaaguagucuagcuuucuuaaaucuuacucagaaugacuuugcuuguacuugugaacaccagaguuuccugcaauggaucaaggaccagaggcagcucuugguggaaguugaacgaauggaaugugcaacaccuucagauaagcagggcaugccugugcugaguuugaauaucaccugucagaugaauaagaccaucauuggugugucgguccucagugugcuuguaguaucuguuguagcaguucuggucuauaaguucuauuuucaccugaugcuucuugcuggcugcauaaaguaugguagaggugaaaacaucuaugaugccuuuguuaucuacucaagccaggaugaggacuggguaaggaaugagcuaguaaagaauuuagaagaaggggugccuccauuucagcucugccuucacuacagagacuuuauucccgguguggccauugcugccaacaucauccaugaagguuuccauaaaagccgaaaggugauuguuguggugucccagcacuucauccagagccgcugguguaucuuugaauaugagauugcucagaccuggcaguuucugagcagucgugcugguaucaucuucauuguccugcagaagguggagaagacccugcucaggcagcagguggagcuguaccgccuucucagcaggaacacuuaccuggagugggaggacaguguccuggggcggcacaucuucuggagacgacucagaaaagcccugcuggaugguaaaucauggaauccagaaggaacaguggguacaggaugcaauuggcaggaagcaacaucuaucugaagaggaaaaauaaaaaccuccugaggcauuucuugcccagcuggguccaacacuuguucaguuaauaaguauuaaaugcugccacaugucaggccuuaugcuaagggugaguaauuccauggugcacuagauaugcagggcugcuaaucucaaggagcuuccagugcagagggaauaaaugcuagacuaaaauacagagucuuccaggugggcauuucaaccaacucagucaaggaacccaugacaaagaaagucauuucaacucuuaccucaucaaguugaauaaagacagagaaaacagaaagagacauuguucuuuuccugagucuuuugaauggaaauuguauuauguuauagccaucauaaaaccauuuugguaguuuugacugaacuggguguucacuuuuuccuuuuugauugaauacaauuuaaauucuacuugaugacugcagucgucaaggggcuccugaugcaagaugccccuuccauuuuaagucugucuccuuacagagguuaaagucuaguggcuaauuccuaaggaaaccugauuaacacaugcucacaaccauccuggucauucucgagcauguucuauuuuuuaacuaaucaccccugauauauuuuuauuuuuauauauccaguuuucauuuuuuuacgucuugccuauaagcuaauaucauaaauaagguuguuuaagacgugcuucaaauauccauauuaaccacuauuuuucaaggaaguauggaaaaguacacucugucacuuugucacucgaugucauuccaaaguuauugccuacuaaguaaugacugucaugaaagcagcauugaaauaauuuguuuaaagggggcacucuuuuaaacgggaagaaaauuuccgcuuccuggucuuaucauggacaauuugggcuagaggcaggaaggaagugggaugaccucaggaggucaccuuuucuugauuccagaaacauaugggcugauaaacccggggugaccucaugaaaugaguugcagcagaaguuuauuuuuuucagaacaagugauguuugauggaccucugaaucucuuuagggagacacagauggcugggaucccuccccuguacccuucucacugccaggagaacuacgugugaagguauucaaggcagggaguauacauugcuguuuccuguugggcaaugcuccuugaccacauuuugggaagaguggauguuaucauugagaaaacaaugugucuggaauuaaugggguucuuauaaagaagguucccagaaaagaauguucauccagccuccucagaaacagaacauucaagaaaaggacaaucaggaugucaucagggaaaugaaaauaaaaaccacaaugagauaucaccuuauaccagguagaauggcuacuauaaaaaaaugaagugucaucaaggauauagagaaauuggaacccuucuucacugcuggagggaauggaaaaugguguagccguuaugaaaaacaguacggagguuucucaaaaauuaaaaauagaacugcuauaugauccagcaaucucacuucuguauauauacccaaaauaauugaaaucagaauuucaagaaaauauuuacacucccauguucauuguggcacucuucacaaucacuguuuccaaaguuauggaaacaacccaaauuuccauugaaaaauaaauggacaaagaaaaugugcauauacguacaaugggauauuauucagccuaaaaaaagggggaauccuguuauuuaugacaacaugaauaaacccggaggccauuaugcuauguaaaaugagcaaguaacagaaagacaaauacugccugauuucauuuauaugagguucuaaaauagucaaacucauagaagcagagaauagaacagugguuccuagggaaaaggaggaagggagaaaugaggaaauagggaguugucuaauugguauaaaauuauaguaugcaagaugaauuagcucuaaagaucagcuguauagcagaguucguauaaugaacaauacuguauuaugcacuuaacauuuuguuaagaggguaccucucauguuaaguguucuuaccauauacauauacacaaggaagcuuuuggaggugauggauauauuuauuaccuugauuguggugaugguuugacagguaugugacuaugucuaaacucaucaaauuguauacauuaaauauaugcaguuuuauaauaucaauuaugucugaaugaagcuauaaaaaagaaaagacaacaaaauucaguugucaaaacuggaaauaugaccacagucagaaguguuuguuacugaguguuucagaguguguuugguuugagcaggucuagggugauugaacaucccuggguguguuuccaugucucauguacuagugaaaguagaugugugcauuugugcacauaucccuauguaucccuaucagggcuguguguauuugaaaguguguguguccgcaugaucauaucuguauagaagagagugugauuauauuucuugaagaauacauccauuugaaauggaugucuauggcuguuugagaugaguucucuacucuugugcuuguacaguagucuccccuuaucccuuaugcuugguggauacguucuuagaccccaaguggaucucugagaccgcagaugguaccaaaccucauauaugcaauauuuuuuccuauacauaaauaccuaagauaaaguucaucuucugaauuaggcacaguaagagauuaacaauaacuaacaauaaaauugaauaguuauaauaauauauuguaauaaaaguuaugugaaugugaucucuuucuuucucucucucaaaaaaaaaaaaaaaaaa

SEQ ID NO: 5 - RNA, 2862 nt, Homo_Sapiens
agauuccuacuucuuacgccccccacaucacccgccucgagaccucaaggguagaggugggcacccccgccuccgcacuuuugcucggggcuccagauuguagggcagggcggcgcuucucggaaagcgaaagccggcggggcggggcgggugccgcaggagaaagaggaagcgcuggcagacaaugcgacccgaccgcgcugaggcuccaggaccgcccgccauggcugcaggaggucccggcgcggggucugcggccccggucuccuccacauccucccuuccccuggcugcucucaacaugcgagugcggcgccgccugucucuguucuugaacgugcggacacagguggcggccgacuggaccgcgcuggcggaggagauggacuuugaguacuuggagauccggcaacuggagacacaagcggaccccacuggcaggcugcuggacgccuggcagggacgcccuggcgccucuguaggccgacugcucgagcugcuuaccaagcugggccgcgacgacgugcugcuggagcugggacccagcauugaggaggauugccaaaaguauaucuugaagcagcagcaggaggaggcugagaagccuuuacagguggccgcuguagacagcagugucccacggacagcagagcuggcgggcaucaccacacuugaugacccccuggggcauaugccugagcguuucgaugccuucaucugcuauugccccagcgacauccaguuugugcaggagaugauccggcaacuggaacagacaaacuaucgacugaaguugugugugucugaccgcgauguccugccuggcaccugugucuggucuauugcuagugagcucaucgaaaagaggugccgccggaugguggugguugucucugaugauuaccugcagagcaaggaaugugacuuccagaccaaauuugcacucagccucucuccaggugcccaucagaagcgacugauccccaucaaguacaaggcaaugaagaaagaguuccccagcauccugagguucaucacugucugcgacuacaccaaccccugcaccaaaucuugguucuggacucgccuugccaaggccuugucccugcccugaagacuguucugaggcccuggguguguguguaucugucugccuguccauguacuucugcccugccuccuccuuucguuguaggaggaaucugugcucuacuuaccucucaauuccuggagaugccaacuucacagacacgucugcagcagcuggacaucacauuucauguccugcauggaaccaguggcugugaguggcauguccacuugcuggauuaucagccaggacacuauagaacaggaccagcugagacuaagaaggaccagcagagccagcucagcucugagccauucacacaucuucacccucaguuuccucacuugaggagugggauggggagaacagagaguagcuguguuugaaucccuguaggaaauggugaagcauagcucugggucuccugggggagaccaggcuuggcugcgggagagcuggcuguugcuggacuacaugcuggccacugcugugaccacgacacugcuggggcagcuucuuccacagugaugccuacugaugcuucagugccucugcacaccgcccauuccacuuccuccuuccccacagggcagguggggaagcaguuuggcccagcccaaggagaccccaccuugagccuuauuuccuaauggguccaccucucaucugcaucuuucacaccucccagcuucugcccaaccuucagcagugacaaguccccaagagacucgccugagcagcuugggcugcuuuucauuuccaccugucaggaugccuguggucaugcucucagcuccaccuggcaugagaagggauccuggccucuggcauauucaucaaguaugaguucuggggaugagucacuguaaugaugugagcagggagccuuccucccugggccaccugcagagagcuuucccaccaacuuuguaccuugauugccuuacaaaguuauuuguuuacaaacagcgaccauauaaaagccuccugccccaaagcuugugggcacaugggcacauacagacucacauacagacacacacauauauguacagacauguacucucacacacacaggcaccagcauacacacguuuuucuagguacagcucccaggaacagcuaggugggaaagucccaucacugagggagccuaaccaugucccugaacaaaaauugggcacucaucuauuccuuuucucuugugucccuacucauugaaaccaaacucuggaaaggacccaauguaccaguauuuauaccucuaaugaagcacagagagaggaagagagcugcuuaaacucacacaacaaugaacugcagacacagcuguucucucccucucuccuucccagagcaauuuauacuuuacccucaggcuguccucuggggagaaggugccauggucuuaggugucugugccccaggacagacccuaggacccuaaauccaauagaaaaugcauaucuuugcuccacuuucagccaggcuggagcaagguaccuuuucuuaggaucuugggagggaauggaugccccucucugcaugaucuuguugaggcauuuagcugccaugcaccugucccccuuuaauacugggcauuuuaaagccaucucaagaggcaucuucuacauguuuuguacgcauuaaaauaauuucaaagauaucugagaaaagccgauauuugccauucuuccuauauccuggaauauaucuugcauccugaguuuauaauaauaaauaauauucuaccuuggaaaaaaaaaaaaaaa

SEQ ID NO: 6 - RNA, 2886 nt, Homo_Sapiens
agauuccuacuucuuacgccccccacaucacccgccucgagaccucaaggguagaggugggcacccccgccuccgcacuuuugcucggggcuccagauuguagggcagggcggcgcuucucggaaagcgaaagccggcggggcggggcgggugccgcaggagaaagaggaagcgcuggcagacaaugcgacccgaccgcgcugaggcuccaggaccgcccgccauggcugcaggaggucccggcgcggggucugcggccccggucuccuccacauccucccuuccccuggcugcucucaacaugcgagugcggcgccgccugucucuguucuugaacgugcggacacagguggcggccgacuggaccgcgcuggcggaggagauggacuuugaguacuuggagauccggcaacuggagacacaagcggaccccacuggcaggcugcuggacgccuggcagggacgcccuggcgccucuguaggccgacugcucgagcugcuuaccaagcugggccgcgacgacgugcugcuggagcugggacccagcauugaggaggauugccaaaaguauaucuugaagcagcagcaggaggaggcugagaagccuuuacagguggccgcuguagacagcagugucccacggacagcagagcuggcgggcaucaccacacuugaugacccccuggggcauaugccugagcguuucgaugccuucaucugcuauugccccagcgacauccaguuugugcaggagaugauccggcaacuggaacagacaaacuaucgacugaaguugugugugucugaccgcgauguccugccuggcaccugugucuggucuauugcuagugagcucaucgaaaagagguuggcuagaaggccacggggugggugccgccggaugguggugguugucucugaugauuaccugcagagcaaggaaugugacuuccagaccaaauuugcacucagccucucuccaggugcccaucagaagcgacugauccccaucaaguacaaggcaaugaagaaagaguuccccagcauccugagguucaucacugucugcgacuacaccaaccccugcaccaaaucuugguucuggacucgccuugccaaggccuugucccugcccugaagacuguucugaggcccuggguguguguguaucugucugccuguccauguacuucugcccugccuccuccuuucguuguaggaggaaucugugcucuacuuaccucucaauuccuggagaugccaacuucacagacacgucugcagcagcuggacaucacauuucauguccugcauggaaccaguggcugugaguggcauguccacuugcuggauuaucagccaggacacuauagaacaggaccagcugagacuaagaaggaccagcagagccagcucagcucugagccauucacacaucuucacccucaguuuccucacuugaggagugggauggggagaacagagaguagcuguguuugaaucccuguaggaaauggugaagcauagcucugggucuccugggggagaccaggcuuggcugcgggagagcuggcuguugcuggacuacaugcuggccacugcugugaccacgacacugcuggggcagcuucuuccacagugaugccuacugaugcuucagugccucugcacaccgcccauuccacuuccuccuuccccacagggcagguggggaagcaguuuggcccagcccaaggagaccccaccuugagccuuauuuccuaauggguccaccucucaucugcaucuuucacaccucccagcuucugcccaaccuucagcagugacaaguccccaagagacucgccugagcagcuugggcugcuuuucauuuccaccugucaggaugccuguggucaugcucucagcuccaccuggcaugagaagggauccuggccucuggcauauucaucaaguaugaguucuggggaugagucacuguaaugaugugagcagggagccuuccucccugggccaccugcagagagcuuucccaccaacuuuguaccuugauugccuuacaaaguuauuuguuuacaaacagcgaccauauaaaagccuccugccccaaagcuugugggcacaugggcacauacagacucacauacagacacacacauauauguacagacauguacucucacacacacaggcaccagcauacacacguuuuucuagguacagcucccaggaacagcuaggugggaaagucccaucacugagggagccuaaccaugucccugaacaaaaauugggcacucaucuauuccuuuucucuugugucccuacucauugaaaccaaacucuggaaaggacccaauguaccaguauuuauaccucuaaugaagcacagagagaggaagagagcugcuuaaacucacacaacaaugaacugcagacacagcuguucucucccucucuccuucccagagcaauuuauacuuuacccucaggcuguccucuggggagaaggugccauggucuuaggugucugugccccaggacagacccuaggacccuaaauccaauagaaaaugcauaucuuugcuccacuuucagccaggcuggagcaagguaccuuuucuuaggaucuugggagggaauggaugccccucucugcaugaucuuguugaggcauuuagcugccaugcaccugucccccuuuaauacugggcauuuuaaagccaucucaagaggcaucuucuacauguuuuguacgcauuaaaauaauuucaaagauaucugagaaaagccgauauuugccauucuuccuauauccuggaauauaucuugcauccugaguuuauaauaauaaauaauauucuaccuuggaaaaaaaaaaaaaaa

SEQ ID NO: 7 - RNA, 2727 nt, Homo_Sapiens
agauuccuacuucuuacgccccccacaucacccgccucgagaccucaaggguagaggugggcacccccgccuccgcacuuuugcucggggcuccagauuguagggcagggcggcgcuucucggaaagcgaaagccggcggggcggggcgggugccgcaggagaaagaggaagcgcuggcagacaaugcgacccgaccgcgcugaggcuccaggaccgcccgccauggcugcaggaggucccggcgcggggucugcggccccggucuccuccacauccucccuuccccuggcugcucucaacaugcgagugcggcgccgccugucucuguucuugaacgugcggacacagguggcggccgacuggaccgcgcuggcggaggagauggacuuugaguacuuggagauccggcaacuggagacacaagcggaccccacuggcaggcugcuggacgccuggcagggacgcccuggcgccucuguaggccgacugcucgagcugcuuaccaagcugggccgcgacgacgugcugcuggagcugggacccagcauugggcauaugccugagcguuucgaugccuucaucugcuauugccccagcgacauccaguuugugcaggagaugauccggcaacuggaacagacaaacuaucgacugaaguugugugugucugaccgcgauguccugccuggcaccugugucuggucuauugcuagugagcucaucgaaaagaggugccgccggaugguggugguugucucugaugauuaccugcagagcaaggaaugugacuuccagaccaaauuugcacucagccucucuccaggugcccaucagaagcgacugauccccaucaaguacaaggcaaugaagaaagaguuccccagcauccugagguucaucacugucugcgacuacaccaaccccugcaccaaaucuugguucuggacucgccuugccaaggccuugucccugcccugaagacuguucugaggcccuggguguguguguaucugucugccuguccauguacuucugcccugccuccuccuuucguuguaggaggaaucugugcucuacuuaccucucaauuccuggagaugccaacuucacagacacgucugcagcagcuggacaucacauuucauguccugcauggaaccaguggcugugaguggcauguccacuugcuggauuaucagccaggacacuauagaacaggaccagcugagacuaagaaggaccagcagagccagcucagcucugagccauucacacaucuucacccucaguuuccucacuugaggagugggauggggagaacagagaguagcuguguuugaaucccuguaggaaauggugaagcauagcucugggucuccugggggagaccaggcuuggcugcgggagagcuggcuguugcuggacuacaugcuggccacugcugugaccacgacacugcuggggcagcuucuuccacagugaugccuacugaugcuucagugccucugcacaccgcccauuccacuuccuccuuccccacagggcagguggggaagcaguuuggcccagcccaaggagaccccaccuugagccuuauuuccuaauggguccaccucucaucugcaucuuucacaccucccagcuucugcccaaccuucagcagugacaaguccccaagagacucgccugagcagcuugggcugcuuuucauuuccaccugucaggaugccuguggucaugcucucagcuccaccuggcaugagaagggauccuggccucuggcauauucaucaaguaugaguucuggggaugagucacuguaaugaugugagcagggagccuuccucccugggccaccugcagagagcuuucccaccaacuuuguaccuugauugccuuacaaaguuauuuguuuacaaacagcgaccauauaaaagccuccugccccaaagcuugugggcacaugggcacauacagacucacauacagacacacacauauauguacagacauguacucucacacacacaggcaccagcauacacacguuuuucuagguacagcucccaggaacagcuaggugggaaagucccaucacugagggagccuaaccaugucccugaacaaaaauugggcacucaucuauuccuuuucucuugugucccuacucauugaaaccaaacucuggaaaggacccaauguaccaguauuuauaccucuaaugaagcacagagagaggaagagagcugcuuaaacucacacaacaaugaacugcagacacagcuguucucucccucucuccuucccagagcaauuuauacuuuacccucaggcuguccucuggggagaaggugccauggucuuaggugucugugccccaggacagacccuaggacccuaaauccaauagaaaaugcauaucuuugcuccacuuucagccaggcuggagcaagguaccuuuucuuaggaucuugggagggaauggaugccccucucugcaugaucuuguugaggcauuuagcugccaugcaccugucccccuuuaauacugggcauuuuaaagccaucucaagaggcaucuucuacauguuuuguacgcauuaaaauaauuucaaagauaucugagaaaagccgauauuugccauucuuccuauauccuggaauauaucuugcauccugaguuuauaauaauaaauaauauucuaccuuggaaaaaaaaaaaaaaa

SEQ ID NO: 8 - RNA, 2681 nt, Homo_Sapiens
agauuccuacuucuuacgccccccacaucacccgccucgagaccucaaggguagaggugggcacccccgccuccgcacuuuugcucggggcuccagauuguagggcagggcggcgcuucucggaaagcgaaagccggcggggcggggcgggugccgcaggagaaagaggaagcgcuggcagacaaugcgacccgaccgcgcugaggcuccaggaccgcccgccauggcugcaggaggucccggcgcggggucugcggccccggucuccuccacauccucccuuccccuggcugcucucaacaugcgagugcggcgccgccugucucuguucuugaacgugcggacacagguggcggccgacuggaccgcgcuggcggaggagauggacuuugaguacuuggagauccggcaacuggagacacaagcggaccccacuggcaggcugcuggacgccuggcagggacgcccuggcgccucuguaggccgacugcucgagcugcuuaccaagcugggccgcgacgacgugcugcuggagcugggacccagcauugaggaggauugccaaaaguauaucuugaagcagcagcaggaggaggcugagaagccuuuacagguggccgcuguagacagcagugucccacggacagcagagcuggcgggcaucaccacacuugaugacccccugggugccgccggaugguggugguugucucugaugauuaccugcagagcaaggaaugugacuuccagaccaaauuugcacucagccucucuccaggugcccaucagaagcgacugauccccaucaaguacaaggcaaugaagaaagaguuccccagcauccugagguucaucacugucugcgacuacaccaaccccugcaccaaaucuugguucuggacucgccuugccaaggccuugucccugcccugaagacuguucugaggcccuggguguguguguaucugucugccuguccauguacuucugcccugccuccuccuuucguuguaggaggaaucugugcucuacuuaccucucaauuccuggagaugccaacuucacagacacgucugcagcagcuggacaucacauuucauguccugcauggaaccaguggcugugaguggcauguccacuugcuggauuaucagccaggacacuauagaacaggaccagcugagacuaagaaggaccagcagagccagcucagcucugagccauucacacaucuucacccucaguuuccucacuugaggagugggauggggagaacagagaguagcuguguuugaaucccuguaggaaauggugaagcauagcucugggucuccugggggagaccaggcuuggcugcgggagagcuggcuguugcuggacuacaugcuggccacugcugugaccacgacacugcuggggcagcuucuuccacagugaugccuacugaugcuucagugccucugcacaccgcccauuccacuuccuccuuccccacagggcagguggggaagcaguuuggcccagcccaaggagaccccaccuugagccuuauuuccuaauggguccaccucucaucugcaucuuucacaccucccagcuucugcccaaccuucagcagugacaaguccccaagagacucgccugagcagcuugggcugcuuuucauuuccaccugucaggaugccuguggucaugcucucagcuccaccuggcaugagaagggauccuggccucuggcauauucaucaaguaugaguucuggggaugagucacuguaaugaugugagcagggagccuuccucccugggccaccugcagagagcuuucccaccaacuuuguaccuugauugccuuacaaaguuauuuguuuacaaacagcgaccauauaaaagccuccugccccaaagcuugugggcacaugggcacauacagacucacauacagacacacacauauauguacagacauguacucucacacacacaggcaccagcauacacacguuuuucuagguacagcucccaggaacagcuaggugggaaagucccaucacugagggagccuaaccaugucccugaacaaaaauugggcacucaucuauuccuuuucucuugugucccuacucauugaaaccaaacucuggaaaggacccaauguaccaguauuuauaccucuaaugaagcacagagagaggaagagagcugcuuaaacucacacaacaaugaacugcagacacagcuguucucucccucucuccuucccagagcaauuuauacuuuacccucaggcuguccucuggggagaaggugccauggucuuaggugucugugccccaggacagacccuaggacccuaaauccaauagaaaaugcauaucuuugcuccacuuucagccaggcuggagcaagguaccuuuucuuaggaucuugggagggaauggaugccccucucugcaugaucuuguugaggcauuuagcugccaugcaccugucccccuuuaauacugggcauuuuaaagccaucucaagaggcaucuucuacauguuuuguacgcauuaaaauaauuucaaagauaucugagaaaagccgauauuugccauucuuccuauauccuggaauauaucuugcauccugaguuuauaauaauaaauaauauucuaccuuggaaaaaaaaaaaaaaa

SEQ ID NO: 9 - RNA, 2546 nt, Homo_Sapiens
agauuccuacuucuuacgccccccacaucacccgccucgagaccucaaggguagaggugggcacccccgccuccgcacuuuugcucggggcuccagauuguagggcagggcggcgcuucucggaaagcgaaagccggcggggcggggcgggugccgcaggagaaagaggaagcgcuggcagacaaugcgacccgaccgcgcugaggcuccaggaccgcccgccauggcugcaggaggucccggcgcggggucugcggccccggucuccuccacauccucccuuccccuggcugcucucaacaugcgagugcggcgccgccugucucuguucuugaacgugcggacacagguggcggccgacuggaccgcgcuggcggaggagauggacuuugaguacuuggagauccggcaacuggagacacaagcggaccccacuggcaggcugcuggacgccuggcagggacgcccuggcgccucuguaggccgacugcucgagcugcuuaccaagcugggccgcgacgacgugcugcuggagcugggacccagcauuggugccgccggaugguggugguugucucugaugauuaccugcagagcaaggaaugugacuuccagaccaaauuugcacucagccucucuccaggugcccaucagaagcgacugauccccaucaaguacaaggcaaugaagaaagaguuccccagcauccugagguucaucacugucugcgacuacaccaaccccugcaccaaaucuugguucuggacucgccuugccaaggccuugucccugcccugaagacuguucugaggcccuggguguguguguaucugucugccuguccauguacuucugcccugccuccuccuuucguuguaggaggaaucugugcucuacuuaccucucaauuccuggagaugccaacuucacagacacgucugcagcagcuggacaucacauuucauguccugcauggaaccaguggcugugaguggcauguccacuugcuggauuaucagccaggacacuauagaacaggaccagcugagacuaagaaggaccagcagagccagcucagcucugagccauucacacaucuucacccucaguuuccucacuugaggagugggauggggagaacagagaguagcuguguuugaaucccuguaggaaauggugaagcauagcucugggucuccugggggagaccaggcuuggcugcgggagagcuggcuguugcuggacuacaugcuggccacugcugugaccacgacacugcuggggcagcuucuuccacagugaugccuacugaugcuucagugccucugcacaccgcccauuccacuuccuccuuccccacagggcagguggggaagcaguuuggcccagcccaaggagaccccaccuugagccuuauuuccuaauggguccaccucucaucugcaucuuucacaccucccagcuucugcccaaccuucagcagugacaaguccccaagagacucgccugagcagcuugggcugcuuuucauuuccaccugucaggaugccuguggucaugcucucagcuccaccuggcaugagaagggauccuggccucuggcauauucaucaaguaugaguucuggggaugagucacuguaaugaugugagcagggagccuuccucccugggccaccugcagagagcuuucccaccaacuuuguaccuugauugccuuacaaaguuauuuguuuacaaacagcgaccauauaaaagccuccugccccaaagcuugugggcacaugggcacauacagacucacauacagacacacacauauauguacagacauguacucucacacacacaggcaccagcauacacacguuuuucuagguacagcucccaggaacagcuaggugggaaagucccaucacugagggagccuaaccaugucccugaacaaaaauugggcacucaucuauuccuuuucucuugugucccuacucauugaaaccaaacucuggaaaggacccaauguaccaguauuuauaccucuaaugaagcacagagagaggaagagagcugcuuaaacucacacaacaaugaacugcagacacagcuguucucucccucucuccuucccagagcaauuuauacuuuacccucaggcuguccucuggggagaaggugccauggucuuaggugucugugccccaggacagacccuaggacccuaaauccaauagaaaaugcauaucuuugcuccacuuucagccaggcuggagcaagguaccuuuucuuaggaucuugggagggaauggaugccccucucugcaugaucuuguugaggcauuuagcugccaugcaccugucccccuuuaauacugggcauuuuaaagccaucucaagaggcaucuucuacauguuuuguacgcauuaaaauaauuucaaagauaucugagaaaagccgauauuugccauucuuccuauauccuggaauauaucuugcauccugaguuuauaauaauaaauaauauucuaccuuggaaaaaaaaaaaaaaa

SEQ ID NO: 10 - RNA, 2720 nt, Homo_Sapiens
gcgggguggagccagcgcccucagcgcgcuacgguccgcgggcaacuccgcagaagccccagcccccaggaccccaggacccaguggcgcagccggcagccccggaucccugaucugcuugggcagcuccugcagaaccuggaacagugaauggguaggggacacugggcgugcagaaggcggggggcaguguggaacaugccuucaccaccuccagcuucugcugccggaggcugcacccaccugugcccauggccugcacaggcccaucacuuccuagcgccuucgacauucuaggugcagcaggccaggacaagcucuuguaucugaagcacaaacugaagaccccacgcccaggcugccaggggcaggaccuccugcaugccaugguucuccugaagcugggccaggaaacugaggccaggaucucucuagaggcauugaaggccgaugcgguggcccggcugguggcccgccagugggcuggcguggacagcaccgaggacccagaggagcccccagauguguccugggcuguggcccgcuuguaccaccugcuggcugaggagaagcugugccccgccucgcugcgggacguggccuaccaggaagccguccgcacccucagcuccagggacgaccaccggcugggggaacuucaggaugaggcccgaaaccggugugggugggacauugcuggggauccagggagcauccggacgcuccaguccaaucugggcugccucccaccauccucggcuuugcccucugggaccaggagccucccacgccccauugacgguguuucggacuggagccaagggugcucccugcgauccacuggcagcccugccucccuggccagcaacuuggaaaucagccaguccccuaccaugcccuuccucagccugcaccgcagcccacaugggcccagcaagcucugugacgacccccaggccagcuuggugcccgagccuguccccgguggcugccaggagccugaggagaugagcuggccgccaucgggggagauugccagcccaccagagcugccaagcagcccaccuccugggcuucccgaaguggccccagaugcaaccuccacuggccucccugauacccccgcagcuccagaaaccagcaccaacuacccaguggagugcaccgaggggucugcaggcccccagucucuccccuugccuauucuggagccggucaaaaaccccugcucugucaaagaccagacgccacuccaacuuucuguagaagauaccaccucuccaaauaccaagccgugcccaccuacucccaccaccccagaaacauccccuccuccuccuccuccuccuccuucaucuacuccuuguucagcucaccugacccccuccucccuguucccuuccucccuggaaucaucaucggaacagaaauucuauaacuuugugauccuccacgccagggcagacgaacacaucgcccugcggguucgggagaagcuggaggcccuuggcgugcccgacggggccaccuucugcgaggauuuccaggugccggggcgcggggagcugagcugccugcaggacgccauagaccacucagcuuucaucauccuacuucucaccuccaacuucgacugucgccugagccugcaccaggugaaccaagccaugaugagcaaccucacgcgacaggggucgccagacugugucauccccuuccugccccuggagagcuccccggcccagcucagcuccgacacggccagccugcucuccgggcuggugcggcuggacgaacacucccagaucuucgccaggaagguggccaacaccuucaagccccacaggcuucaggcccgaaaggccauguggaggaaggaacaggacacccgagcccugcgggaacagagccaacaccuggacggugagcggaugcaggcggcggcacugaacgcagccuacucagccuaccuccagagcuacuuguccuaccaggcacagauggagcagcuccagguggcuuuugggagccacaugucauuugggacuggggcgcccuauggggcucgaaugcccuuugggggccaggugccccugggagccccgccacccuuucccacuuggccggggugcccgcagccgccaccccugcacgcauggcaggcuggcacccccccaccgcccuccccacagccagcagccuuuccacagucacugcccuucccgcaguccccagccuucccuacggccucacccgcacccccucagagcccagggcugcaaccccucauuauccaccacgcacagaugguacagcuggggcugaacaaccacauguggaaccagagagggucccaggcgcccgaggacaagacgcaggaggcagaaugaccgcguguccuugccugaccaccuggggaacaccccuggacccaggcaucggccaggaccccauagagcaccccggucugcccugugcccuguggacaguggaagaugaggucaucugccacuuucaggacauuguccgggagcccuucauuuaggacaaaacgggcgcgaugaugcccuggcuuucaggguggucagaacuggauacgguguuuacaauuccaaucucucuauuucugggugaagggucuuggugguggggguauugcuacggucuuuuaauuauaauaaauauuuauugaaugcuuccgcaaaaaaaaaaaaaaaaaa

SEQ ID NO: 11 - RNA, 1219 nt, Homo_Sapiens
gcgcugcucuuccccgcggagcccgcgcaguccgcgcagcccucaucgcaacugggcccgcgcgcagauccaccaaagagaaagcagcccugugccaguugcucugccagccuuucacaggagaagugucacuagaauacuacagcccccacaggcucugcuccacagaaacuuaaggcugaaagaguguccgccaucagggacauccucugucacuacggugggaaaagaacauggccuuacauaggaaguccuucuaaagagcugccugccagcugcccuuccccagaucccgaauauccuccuggccagguggagcagagaacaguuccucagcuggucaugcugagcucauacccugauggcugcuccaugaggucaagacugggucuccucccuccucccccuucaccaaugccuggucucacggggcuaguuuugacccccacgcuauggcaucaucgaccucccucccagcuccuggcucucggccuaagaagccucuaggcaagauggcugacugguucaggcagacccugcugaagaagcccaagaagaggcccaacuccccagaaagcaccuccagcgaugcuucacagccuaccucacaggacagcccacuacccccaagccucagcucagucacgucucccagccugccacccacacaugcgagugacaguggcaguagucgcuggagcaaagacuaugacgucugcgugugccacagugaggaagaccugguggccgcccaggaccuggucuccuacuuggaaggcagcacugccagccugcgcugcuuccugcaacuccgggaugcaaccccaggcggcgcuauaguguccgagcugugccaggcacugagcaguagucacugccgggugcugcucaucacgccgggcuuccuucaggaccccuggugcaaguaccagaugcugcaggcccugaccgaggcuccaggggccgagggcugcaccaucccccugcugucgggccucagcagagcugccuacccaccugagcuccgauucauguacuacgucgauggcaggggcccugaugguggcuuucgucaagucaaagaagcugucaugcguuguaagcuacuacaggagggagaaggggaacgggauucagcuacaguaucugaucuacuuugacuuuuaggagacagcccuguagccuaguaguucaaagcgcagcuucuggaaaaggcugu

SEQ ID NO: 12 - RNA, 2348 nt, Homo sapiens
gcgcugcucuuccccgcggagcccgcgcaguccgcgcagcccucaucgcaacugggcccgcgcgcagauccaccaaagagaaagcagcccugugccaguugcucugccagccuuucacaggagaagugucacuagaauacuacagcccccacaggcucugcuccacagaaacuuaaggcugaaagaguguccgccaucagggacauccucugucacuacggccuuacauaggaaguccuucuaaagagcugccugccagcugcccuuccccagaucccgaauauccuccuggccagguggagcagagaacaguuccucagcuggucaugcugagcucauacccugauggcugcuccaugaggucaagacugggucuccucccuccucccccuucaccaaugccuggucucacggggcuaguuuugacccccacgcuauggcaucaucgaccucccucccagcuccuggcucucggccuaagaagccucuaggcaagauggcugacugguucaggcagacccugcugaagaagcccaagaagaggcccaacuccccagaaagcaccuccagcgaugcuucacagccuaccucacaggacagcccacuacccccaagccucagcucagucacgucucccagccugccacccacacaugcgagugacaguggcaguagucgcuggagcaaagacuaugacgucugcgugugccacagugaggaagaccugguggccgcccaggaccuggucuccuacuuggaaggcagcacugccagccugcgcugcuuccugcaacuccgggaugcaaccccaggcggcgcuauaguguccgagcugugccaggcacugagcaguagucacugccgggugcugcucaucacgccgggcuuccuucaggaccccuggugcaaguaccagaugcugcaggcccugaccgaggcuccaggggccgagggcugcaccaucccccugcugucgggccucagcagagcugccuacccaccugagcuccgauucauguacuacgucgauggcaggggcccugaugguggcuuucgucaagucaaagaagcugucaugcguuaucugcagacacucaguugacacuuguuauaucaugggaccccggaaauuggagugaagcuagaaacagaaaacccaugcagggccucggauucccacaaaugugacaagagguauagggagugagucacagcgcuuugcucgugacccugggaucagagcacccaucaggcuuccauuacugugggcucccuaagaagaccauggagagcuuggggacucccccaggaaggccgugaagcuggggauucccccuaggaaagccaugaggaagcuggggacuccccaagaaggccaugaggaagccagaaauuggaggugguaggaagugguacugaucaaugauggccagcaggacucaucuccugccuaacuggacaggaagccuggcacccacuucugucuuccccuggaacugggcacuggcguacacugguaucccuccuaaagaagugacucaccugacugaucagcaagaagccuagauugcaggccucaccauggauggucuuccuaguugccuggggaaacccuggaaugggcaucaggagaaagcaacaagaauccaguccuucacacucacacuacucuguuccucuucccagagacaucgauucacuucaaagagcuguagggaagaugcagucagcacugcacuguauuuuuuauuuauugccuaggugccauuaaagacacaaaccuagaagccuagaggccauucugaauauggggguggggugguggagggagcaagugaagagaugggaauccagggcucaggguucaaugccuucaccugagaucacaagcccauggaugcugugacaucugggagcuucaucaguggucuggcuaaagcugauacuuucacagucaccaucuucaccuuuggacugggaagaaucaccauuuuucuucuggcagaugacuguauuccuuauaggacaggcaagguuucauucaucuguucucaguaaguuuguuguugaacugaaaugaauuucauuauuuccuccaauguguacuuuugugccccccucucacuucucccuaucaugaccccucuuuugcugaaaaaaauuuuuauuauuuuuucuaucucuaguucuagaaagagaaaauuuauuuuuuaaauuauaaacuauuuugccaggcgccauggcucacaccuguaaucucagcacuuugggaggccgaggcagguggaucaccugaggucaggaguucaagacuagccuggccaauauggugaaacccugucucuacu

SEQ ID NO: 13 - RNA, 19 nt, artificial
  Chemically synthesized
gcugcauauuccaagguuu

SEQ ID NO: 14 - RNA, 19 nt, artificial
  Chemically synthesized
ggaagauaaugaacaccaa

SEQ ID NO: 15 - RNA, 19 nt, artificial
  Chemically synthesized
cccucucuacaaacuuuaa

SEQ ID NO: 16 - RNA, 19 nt, artificial
  Chemically synthesized
ggagcccauugagaaaaaa

SEQ ID NO: 17 - RNA, 19 nt, artificial
  Chemically synthesized
cggaguucucccaguguuu

SEQ ID NO: 18 - RNA, 19 nt, artificial
  Chemically synthesized
cccuuaauggaguugguaa

SEQ ID NO: 19 - RNA, 19 nt, artificial
  Chemically synthesized
gagauaaccaugaucauaa

SEQ ID NO: 20 - RNA, 19 nt, artificial
  Chemically synthesized
gggacuucauuccuggcaa

SEQ ID NO: 21 - RNA, 19 nt, artificial
  Chemically synthesized
gucuauuacugauaucuga

SEQ ID NO: 22 - RNA, 19 nt, artificial
  Chemically synthesized
ccaaaaaguuugaagucaa

SEQ ID NO: 23 - RNA, 19 nt, artificial
  Chemically synthesized
ggagcaacuugacucauuu

SEQ ID NO: 24 - RNA, 19 nt, artificial
  Chemically synthesized
ggccugugguauaugaaaa

SEQ ID NO: 25 - RNA, 19 nt, artificial
  Chemically synthesized
ggcucagcgggaaggauuu

SEQ ID NO: 26 - RNA, 19 nt, artificial
  Chemically synthesized
ggagauuuuuguagauguu

SEQ ID NO: 27 - RNA, 19 nt, artificial
  Chemically synthesized
gguuccuuguuuacuuuca

SEQ ID NO: 28 - RNA, 19 nt, artificial
  Chemically synthesized
gcaacaaggcaaaguauuu

SEQ ID NO: 29 - RNA, 19 nt, artificial
  Chemically synthesized
cuuucuuccugcuaagaga

SEQ ID NO: 30 - RNA, 19 nt, artificial
  Chemically synthesized
gaccagucuuugucuaguu

SEQ ID NO: 31 - RNA, 19 nt, artificial
  Chemically synthesized
ggcuuaguucauuaggaaa

SEQ ID NO: 32 - RNA, 19 nt, artificial
  Chemically synthesized
gcccucucuacaaacuuua

SEQ ID NO: 33 - RNA, 19 nt, artificial
  Chemically synthesized
ccaugaucauaagucuauu

SEQ ID NO: 34 - RNA, 19 nt, artificial
  Chemically synthesized
cuuguuuacuuucacaaca

SEQ ID NO: 35 - RNA, 19 nt, artificial
  Chemically synthesized
ggguugaagcacuggacaa

SEQ ID NO: 36 - RNA, 19 nt, artificial
  Chemically synthesized
gucuaguugggaucuuuau

SEQ ID NO: 37 - RNA, 19 nt, artificial
  Chemically synthesized
ggaucuuuaugucacuagu

SEQ ID NO: 38 - RNA, 19 nt, artificial
  Chemically synthesized
ggaaaaaaccggagagacu

SEQ ID NO: 39 - RNA, 19 nt, artificial
  Chemically synthesized
gcuguguauuuccuauuaa

SEQ ID NO: 40 - RNA, 19 nt, artificial
  Chemically synthesized
ggaucucagugaaaauuug

SEQ ID NO: 41 - RNA, 19 nt, artificial
  Chemically synthesized
cauucuuucuuccugcuaa

SEQ ID NO: 42 - RNA, 19 nt, artificial
  Chemically synthesized
ggauccaaaggagaccuau

SEQ ID NO: 43 - RNA, 19 nt, artificial
  Chemically synthesized
cugggaaauccuuacaaaa

SEQ ID NO: 44 - RNA, 19 nt, artificial
  Chemically synthesized
gucuuuuugaugagaacaa

SEQ ID NO: 45 - RNA, 19 nt, artificial
  Chemically synthesized
ggugaaacaaauucauuga

SEQ ID NO: 46 - RNA, 19 nt, artificial
  Chemically synthesized
cugucuuugugcuuucuga

SEQ ID NO: 47 - RNA, 19 nt, artificial
  Chemically synthesized
agaacuauccacuggugaa

SEQ ID NO: 48 - RNA, 19 nt, artificial
  Chemically synthesized
guuugaagucaauucagaa

SEQ ID NO: 49 - RNA, 19 nt, artificial
  Chemically synthesized
uggagcccauugagaaaaa

SEQ ID NO: 50 - RNA, 19 nt, artificial
  Chemically synthesized
cccaaaacuuguugcuauu

SEQ ID NO: 51 - RNA, 19 nt, artificial
  Chemically synthesized
ugucuaguugggaucuuua

SEQ ID NO: 52 - RNA, 19 nt, artificial
  Chemically synthesized
ggugcaaguaugaacugga

SEQ ID NO: 53 - RNA, 19 nt, artificial
  Chemically synthesized
guugcuauuccuagaaaaa

SEQ ID NO: 54 - RNA, 19 nt, artificial
  Chemically synthesized
cgggaaggauuuuggguaa

SEQ ID NO: 55 - RNA, 19 nt, artificial
  Chemically synthesized
ggcugcauauuccaagguu

SEQ ID NO: 56 - RNA, 19 nt, artificial
  Chemically synthesized
cucugaaaaacuugacuaa

SEQ ID NO: 57 - RNA, 19 nt, artificial
  Chemically synthesized
gagacuuugcucacucuga

SEQ ID NO: 58 - RNA, 19 nt, artificial
  Chemically synthesized
cucuuagugaccaagugaa

SEQ ID NO: 59 - RNA, 19 nt, artificial
  Chemically synthesized
uggagaaccuuauggucca

SEQ ID NO: 60 - RNA, 19 nt, artificial
  Chemically synthesized
ggaucauugacaauaucau

SEQ ID NO: 61 - RNA, 19 nt, artificial
  Chemically synthesized
ggaucaccuacauuagcaa

SEQ ID NO: 62 - RNA, 19 nt, artificial
  Chemically synthesized
ggagcuggagaacuucaau

SEQ ID NO: 63 - RNA, 19 nt, artificial
  Chemically synthesized
ggcucacagaagcuguaaa

SEQ ID NO: 64 - RNA, 19 nt, artificial
  Chemically synthesized
aguggaucauugacaauau

SEQ ID NO: 65 - RNA, 19 nt, artificial
  Chemically synthesized
gccaaagucuugauugauu

SEQ ID NO: 66 - RNA, 19 nt, artificial
  Chemically synthesized
gaacaaugaugcugccauu

SEQ ID NO: 67 - RNA, 19 nt, artificial
  Chemically synthesized
agacuuugcucacucugaa

SEQ ID NO: 68 - RNA, 19 nt, artificial
  Chemically synthesized
gucuuugucuaguugggau

SEQ ID NO: 69 - RNA, 19 nt, artificial
  Chemically synthesized
cuggauuguuagaauuaga

SEQ ID NO: 70 - RNA, 19 nt, artificial
  Chemically synthesized
gacuaacauugauaucagu

SEQ ID NO: 71 - RNA, 19 nt, artificial
  Chemically synthesized
guugcaagcaggauccaaa

SEQ ID NO: 72 - RNA, 19 nt, artificial
  Chemically synthesized
ggguggagaaccuuauggu

SEQ ID NO: 73 - RNA, 19 nt, artificial
  Chemically synthesized
guugaugacucuaccagau

SEQ ID NO: 74 - RNA, 19 nt, artificial
  Chemically synthesized
cacaguugguugacuucau

SEQ ID NO: 75 - RNA, 19 nt, artificial
  Chemically synthesized
cucuggugcugacauccaa

SEQ ID NO: 76 - RNA, 19 nt, artificial
  Chemically synthesized
cgcaacucaaagaacuuua

SEQ ID NO: 77 - RNA, 19 nt, artificial
  Chemically synthesized
ggacuugcuuacuaaaacu

SEQ ID NO: 78 - RNA, 19 nt, artificial
  Chemically synthesized
gaugcagaacccauggaua

SEQ ID NO: 79 - RNA, 19 nt, artificial
  Chemically synthesized
cuuggaucucagugaaaau

SEQ ID NO: 80 - RNA, 19 nt, artificial
  Chemically synthesized
uguugcuauuccuagaaaa

SEQ ID NO: 81 - RNA, 19 nt, artificial
  Chemically synthesized
ggacaaugccacauacuuu

SEQ ID NO: 82 - RNA, 19 nt, artificial
  Chemically synthesized
ggaacugcgagauacugau

SEQ ID NO: 83 - RNA, 19 nt, artificial
  Chemically synthesized
cccaguguuugguguugca

SEQ ID NO: 84 - RNA, 19 nt, artificial
  Chemically synthesized
caacuggcuuaguucauua

SEQ ID NO: 85 - RNA, 19 nt, artificial
  Chemically synthesized
guccuagguucccauauuu

SEQ ID NO: 86 - RNA, 19 nt, artificial
  Chemically synthesized
gaguuauagauccagguaa

SEQ ID NO: 87 - RNA, 19 nt, artificial
  Chemically synthesized
gccgcaacucaaagaacuu

SEQ ID NO: 88 - RNA, 19 nt, artificial
  Chemically synthesized
aguugaugacucuaccaga

SEQ ID NO: 89 - RNA, 19 nt, artificial
  Chemically synthesized
ugggcagucuugaacauuu

SEQ ID NO: 90 - RNA, 19 nt, artificial
  Chemically synthesized
acacgaauacacaguguaa

SEQ ID NO: 91 - RNA, 19 nt, artificial
  Chemically synthesized
ugugcuuucugaaaacuuu

SEQ ID NO: 92 - RNA, 19 nt, artificial
  Chemically synthesized
agagcaacaaggcaaagua

SEQ ID NO: 93 - RNA, 19 nt, artificial
  Chemically synthesized
ccuacauuagcaacaguga

SEQ ID NO: 94 - RNA, 19 nt, artificial
  Chemically synthesized
agaaaaaagugcuguguau

SEQ ID NO: 95 - RNA, 19 nt, artificial
  Chemically synthesized
gucggaaugucacaggaca

SEQ ID NO: 96 - RNA, 19 nt, artificial
  Chemically synthesized
ccaauggaauuaacacaau

SEQ ID NO: 97 - RNA, 19 nt, artificial
  Chemically synthesized
cacacugaagacuuuggaa

SEQ ID NO: 98 - RNA, 19 nt, artificial
  Chemically synthesized
cuucauaugaagcagcaua

SEQ ID NO: 99 - RNA, 19 nt, artificial
  Chemically synthesized
ggugacugcucggaguucu

SEQ ID NO: 100 - RNA, 19 nt, artificial
  Chemically synthesized
cacaguagaaaacaguaaa

SEQ ID NO: 101 - RNA, 19 nt, artificial
  Chemically synthesized
cugguuccuuguuuacuuu

SEQ ID NO: 102 - RNA, 19 nt, artificial
  Chemically synthesized
cuggagcccauugagaaaa

SEQ ID NO: 103 - RNA, 19 nt, artificial
  Chemically synthesized
ccuucaaguugugucuuca

SEQ ID NO: 104 - RNA, 19 nt, artificial
  Chemically synthesized
gcuaugagccaaaaaguuu

SEQ ID NO: 105 - RNA, 19 nt, artificial
  Chemically synthesized
caaugacugugucauucuu

SEQ ID NO: 106 - RNA, 19 nt, artificial
  Chemically synthesized
cauugagaaaaaagccauu

SEQ ID NO: 107 - RNA, 19 nt, artificial
  Chemically synthesized
caguguaacaggcugcauu

SEQ ID NO: 108 - RNA, 19 nt, artificial
  Chemically synthesized
gucuuugugcuuucugaaa

SEQ ID NO: 109 - RNA, 19 nt, artificial
  Chemically synthesized
gcaacucaaagaacuuuau

SEQ ID NO: 110 - RNA, 19 nt, artificial
  Chemically synthesized
cauauuuaagaccagucuu

SEQ ID NO: 111 - RNA, 19 nt, artificial
  Chemically synthesized
ggaacuugagauugaugcu

SEQ ID NO: 112 - RNA, 19 nt, artificial
  Chemically synthesized
cugaaaaacuugacuaaca

SEQ ID NO: 113 - RNA, 19 nt, artificial
  Chemically synthesized
gguugaagcacuggacaau

SEQ ID NO: 114 - RNA, 19 nt, artificial
  Chemically synthesized
cccuuucuucuuuaacauu

SEQ ID NO: 115 - RNA, 19 nt, artificial
  Chemically synthesized
cccuugguauccaagggaa

SEQ ID NO: 116 - RNA, 19 nt, artificial
  Chemically synthesized
acuugagauugaugcuuca

SEQ ID NO: 117 - RNA, 19 nt, artificial
  Chemically synthesized
cauugaaaagagccacaaa

SEQ ID NO: 118 - RNA, 19 nt, artificial
  Chemically synthesized
acuuggaucucagugaaaa

SEQ ID NO: 119 - RNA, 19 nt, artificial
  Chemically synthesized
aucugauccuucauaugaa

SEQ ID NO: 120 - RNA, 19 nt, artificial
  Chemically synthesized
gagcaacaaggcaaaguau

SEQ ID NO: 121 - RNA, 19 nt, artificial
  Chemically synthesized
gguggcaauaacuucauuu

SEQ ID NO: 122 - RNA, 19 nt, artificial
  Chemically synthesized
cuugcuuacuaaaacuaca

SEQ ID NO: 123 - RNA, 19 nt, artificial
  Chemically synthesized
aguccuagguucccauauu

SEQ ID NO: 124 - RNA, 19 nt, artificial
  Chemically synthesized
ggacuucauuccuggcaag

SEQ ID NO: 125 - RNA, 19 nt, artificial
  Chemically synthesized
gggccaacuguaaucugua

SEQ ID NO: 126 - RNA, 19 nt, artificial
  Chemically synthesized
gccagaaaagaugaaauau

SEQ ID NO: 127 - RNA, 19 nt, artificial
  Chemically synthesized
gagagacuuugcucacucu

SEQ ID NO: 128 - RNA, 19 nt, artificial
  Chemically synthesized
ugcuguguauuuccuauua

SEQ ID NO: 129 - RNA, 19 nt, artificial
  Chemically synthesized
gccaaaaaguuugaaguca

SEQ ID NO: 130 - RNA, 19 nt, artificial
  Chemically synthesized
gugaguggugcaaguauga

SEQ ID NO: 131 - RNA, 19 nt, artificial
  Chemically synthesized
gacucauuucacacacuga

SEQ ID NO: 132 - RNA, 19 nt, artificial
  Chemically synthesized
agagcaucugauaaugaca

SEQ ID NO: 133 - RNA, 19 nt, artificial
  Chemically synthesized
cugcuaugaugcauuuguu

SEQ ID NO: 134 - RNA, 19 nt, artificial
  Chemically synthesized
ggguccugugccaccguuu

SEQ ID NO: 135 - RNA, 19 nt, artificial
  Chemically synthesized
gcaaguaugaacuggacuu

SEQ ID NO: 136 - RNA, 19 nt, artificial
  Chemically synthesized
agcugcggaagauaaugaa

SEQ ID NO: 137 - RNA, 19 nt, artificial
  Chemically synthesized
cacuuacagaaagaguuaa

SEQ ID NO: 138 - RNA, 19 nt, artificial
  Chemically synthesized
gucuugaacauuuagacuu

SEQ ID NO: 139 - RNA, 19 nt, artificial
  Chemically synthesized
ccauugagaaaaaagccau

SEQ ID NO: 140 - RNA, 19 nt, artificial
  Chemically synthesized
aucugauaaugacagaguu

SEQ ID NO: 141 - RNA, 19 nt, artificial
  Chemically synthesized
agaccagucuuugucuagu

SEQ ID NO: 142 - RNA, 19 nt, artificial
  Chemically synthesized
gugugaaccuccaggcucu

SEQ ID NO: 143 - RNA, 19 nt, artificial
  Chemically synthesized
ggcuccaggccaaaaggaa

SEQ ID NO: 144 - RNA, 19 nt, artificial
  Chemically synthesized
gcugcauucccaagacacu

SEQ ID NO: 145 - RNA, 19 nt, artificial
  Chemically synthesized
ccugugaauuccucuccuu

SEQ ID NO: 146 - RNA, 19 nt, artificial
  Chemically synthesized
gagccacaaaacugucuuu

SEQ ID NO: 147 - RNA, 19 nt, artificial
  Chemically synthesized
ccuugaggaacuugagauu

SEQ ID NO: 148 - RNA, 19 nt, artificial
  Chemically synthesized
cacuuuccauuuuucagaa

SEQ ID NO: 149 - RNA, 19 nt, artificial
  Chemically synthesized
gggccuggcuccaggccaa

SEQ ID NO: 150 - RNA, 19 nt, artificial
  Chemically synthesized
gacuuugcucacucugaaa

SEQ ID NO: 151 - RNA, 19 nt, artificial
  Chemically synthesized
ggauuguuagaauuagagu

SEQ ID NO: 152 - RNA, 19 nt, artificial
  Chemically synthesized
aguuguggguugaagcacu

SEQ ID NO: 153 - RNA, 19 nt, artificial
  Chemically synthesized
cugacauccaauggaauua

SEQ ID NO: 154 - RNA, 19 nt, artificial
  Chemically synthesized
ggcaauaacuucauuugcu

SEQ ID NO: 155 - RNA, 19 nt, artificial
  Chemically synthesized
guuugaugacuguacccuu

SEQ ID NO: 156 - RNA, 19 nt, artificial
  Chemically synthesized
gcucacagaagcuguaaaa

SEQ ID NO: 157 - RNA, 19 nt, artificial
  Chemically synthesized
gaaaaaaccggagagacuu

SEQ ID NO: 158 - RNA, 19 nt, artificial
  Chemically synthesized
gaucuuuaugucacuaguu

SEQ ID NO: 159 - RNA, 19 nt, artificial
  Chemically synthesized
gccugugguauaugaaaau

SEQ ID NO: 160 - RNA, 19 nt, artificial
  Chemically synthesized
ggcaaguggaucauugaca

SEQ ID NO: 161 - RNA, 19 nt, artificial
  Chemically synthesized
gaugcauuuguuucuuaca

SEQ ID NO: 162 - RNA, 19 nt, artificial
  Chemically synthesized
agcaacaaggcaaaguauu

SEQ ID NO: 163 - RNA, 19 nt, artificial
  Chemically synthesized
cugcauauuccaagguuuu

SEQ ID NO: 164 - RNA, 19 nt, artificial
  Chemically synthesized
cgagauacugauuuggaca

SEQ ID NO: 165 - RNA, 19 nt, artificial
  Chemically synthesized
ugcagaacccauggauaua

SEQ ID NO: 166 - RNA, 19 nt, artificial
  Chemically synthesized
gaucugagcacuuuauauu

SEQ ID NO: 167 - RNA, 19 nt, artificial
  Chemically synthesized
gaucauaagucuauuacug

SEQ ID NO: 168 - RNA, 19 nt, artificial
  Chemically synthesized
ggauccucguggauaucaa

SEQ ID NO: 169 - RNA, 19 nt, artificial
  Chemically synthesized
ucuggagcccauugagaaa

SEQ ID NO: 170 - RNA, 19 nt, artificial
  Chemically synthesized
gaauauagucccuugguau

SEQ ID NO: 171 - RNA, 19 nt, artificial
  Chemically synthesized
cucaagagcaacaaggcaa

SEQ ID NO: 172 - RNA, 19 nt, artificial
  Chemically synthesized
gcuucugcaagcugcggaa

SEQ ID NO: 173 - RNA, 19 nt, artificial
  Chemically synthesized
cagugaaaauuugaugguu

SEQ ID NO: 174 - RNA, 19 nt, artificial
  Chemically synthesized
gaaaguuuguuucagguua

SEQ ID NO: 175 - RNA, 19 nt, artificial
  Chemically synthesized
ccucucuacaaacuuuaau

SEQ ID NO: 176 - RNA, 19 nt, artificial
  Chemically synthesized
ugagauaaccaugaucaua

SEQ ID NO: 177 - RNA, 19 nt, artificial
  Chemically synthesized
caaggaagaauccuccaau

SEQ ID NO: 178 - RNA, 19 nt, artificial
  Chemically synthesized
gcucuuucacugcuuucaa

SEQ ID NO: 179 - RNA, 19 nt, artificial
  Chemically synthesized
cuggcuuaguucauuagga

SEQ ID NO: 180 - RNA, 19 nt, artificial
  Chemically synthesized
gcaacuggcuuaguucauu

SEQ ID NO: 181 - RNA, 19 nt, artificial
  Chemically synthesized
ucggaguucucccaguguu

SEQ ID NO: 182 - RNA, 19 nt, artificial
  Chemically synthesized
ccaaaaggaagcccaggaa

SEQ ID NO: 183 - RNA, 19 nt, artificial
  Chemically synthesized
ugcucggaguucucccagu

SEQ ID NO: 184 - RNA, 19 nt, artificial
  Chemically synthesized
gccacaaaaggcauucucu

SEQ ID NO: 185 - RNA, 19 nt, artificial
  Chemically synthesized
uggaguugguaauuuuaga

SEQ ID NO: 186 - RNA, 19 nt, artificial
  Chemically synthesized
acaccuucacuaagauuca

SEQ ID NO: 187 - RNA, 19 nt, artificial
  Chemically synthesized
cggagagacuuugcucacu

SEQ ID NO: 188 - RNA, 19 nt, artificial
  Chemically synthesized
cguggauaucaaaauucau

SEQ ID NO: 189 - RNA, 19 nt, artificial
  Chemically synthesized
acgaauacacaguguaaca

SEQ ID NO: 190 - RNA, 19 nt, artificial
  Chemically synthesized
acuuguugcuauuccuaga

SEQ ID NO: 191 - RNA, 19 nt, artificial
  Chemically synthesized
agcuaugagccaaaaaguu

SEQ ID NO: 192 - RNA, 19 nt, artificial
  Chemically synthesized
gagugaguggugcaaguau

SEQ ID NO: 193 - RNA, 19 nt, artificial
  Chemically synthesized
guuuguuucagguuaugaa

SEQ ID NO: 194 - RNA, 19 nt, artificial
  Chemically synthesized
gggcucacagaagcuguaa

SEQ ID NO: 195 - RNA, 19 nt, artificial
  Chemically synthesized
caguaggaaugcaauaacu

SEQ ID NO: 196 - RNA, 19 nt, artificial
  Chemically synthesized
ugcauuuguuucuuacagu

SEQ ID NO: 197 - RNA, 19 nt, artificial
  Chemically synthesized
accuucacuaagauucaaa

SEQ ID NO: 198 - RNA, 19 nt, artificial
  Chemically synthesized
ccuacuggguggagaaccu

SEQ ID NO: 199 - RNA, 19 nt, artificial
  Chemically synthesized
gcaagcugcggaagauaau

SEQ ID NO: 200 - RNA, 19 nt, artificial
  Chemically synthesized
gcaaaaucauuuggcauca

SEQ ID NO: 201 - RNA, 19 nt, artificial
  Chemically synthesized
caaaaggaagcccaggaaa

SEQ ID NO: 202 - RNA, 19 nt, artificial
  Chemically synthesized
ccaaggaagaauccuccaa

SEQ ID NO: 203 - RNA, 19 nt, artificial
  Chemically synthesized
gugaaaaucaccgaugaaa

SEQ ID NO: 204 - RNA, 19 nt, artificial
  Chemically synthesized
gcugacauccaauggaauu

SEQ ID NO: 205 - RNA, 19 nt, artificial
  Chemically synthesized
ggacgaggcucagcgggaa

SEQ ID NO: 206 - RNA, 19 nt, artificial
  Chemically synthesized
cgucuuuuugaugagaaca

SEQ ID NO: 207 - RNA, 19 nt, artificial
  Chemically synthesized
ugcaagcugcggaagauaa

SEQ ID NO: 208 - RNA, 19 nt, artificial
  Chemically synthesized
cuggcaaguggaucauuga

SEQ ID NO: 209 - RNA, 19 nt, artificial
  Chemically synthesized
gcaggaacaucugcuauga

SEQ ID NO: 210 - RNA, 19 nt, artificial
  Chemically synthesized
ugguugaagaauacuugaa

SEQ ID NO: 211 - RNA, 19 nt, artificial
  Chemically synthesized
caucucacaaaauugcaaa

SEQ ID NO: 212 - RNA, 19 nt, artificial
  Chemically synthesized
aguuugaagucaauucaga

SEQ ID NO: 213 - RNA, 19 nt, artificial
  Chemically synthesized
caucugcuaugaugcauuu

SEQ ID NO: 214 - RNA, 19 nt, artificial
  Chemically synthesized
cagccucuccaaggaagaa

SEQ ID NO: 215 - RNA, 19 nt, artificial
  Chemically synthesized
auauggacaccuucacuaa

SEQ ID NO: 216 - RNA, 19 nt, artificial
  Chemically synthesized
gggaaggauuuuggguaaa

SEQ ID NO: 217 - RNA, 19 nt, artificial
  Chemically synthesized
acuugucaguggccagaaa

SEQ ID NO: 218 - RNA, 19 nt, artificial
  Chemically synthesized
aggcugcauucccaagaca

SEQ ID NO: 219 - RNA, 19 nt, artificial
  Chemically synthesized
ccgucuuuuugaugagaac

SEQ ID NO: 220 - RNA, 19 nt, artificial
  Chemically synthesized
cagagcuaugagccaaaaa

SEQ ID NO: 221 - RNA, 19 nt, artificial
  Chemically synthesized
guucccauauuuaagacca

SEQ ID NO: 222 - RNA, 19 nt, artificial
  Chemically synthesized
gcugguggcaauaacuuca

SEQ ID NO: 223 - RNA, 19 nt, artificial
  Chemically synthesized
ugucuuugugcuuucugaa

SEQ ID NO: 224 - RNA, 19 nt, artificial
  Chemically synthesized
gcuuucaacugguaguugu

SEQ ID NO: 225 - RNA, 19 nt, artificial
  Chemically synthesized
gcgggaaggauuuugggua

SEQ ID NO: 226 - RNA, 19 nt, artificial
  Chemically synthesized
aucuguagcaacuggcuua

SEQ ID NO: 227 - RNA, 19 nt, artificial
  Chemically synthesized
cauaugaagcagcauauuu

SEQ ID NO: 228 - RNA, 19 nt, artificial
  Chemically synthesized
gagccaaaaaguuugaagu

SEQ ID NO: 229 - RNA, 19 nt, artificial
  Chemically synthesized
cugcggaagauaaugaaca

SEQ ID NO: 230 - RNA, 19 nt, artificial
  Chemically synthesized
ccauauuuaagaccagucu

SEQ ID NO: 231 - RNA, 19 nt, artificial
  Chemically synthesized
gaucucagugaaaauuuga

SEQ ID NO: 232 - RNA, 19 nt, artificial
  Chemically synthesized
cuugaaaaauucagccugu

SEQ ID NO: 233 - RNA, 19 nt, artificial
  Chemically synthesized
caagacacuggaaauuuua

SEQ ID NO: 234 - RNA, 19 nt, artificial
  Chemically synthesized
gccucuccaaggaagaauc

SEQ ID NO: 235 - RNA, 19 nt, artificial
  Chemically synthesized
gggugcuguuuuauaaaca

SEQ ID NO: 236 - RNA, 19 nt, artificial
  Chemically synthesized
uaagaccagucuuugucua

SEQ ID NO: 237 - RNA, 19 nt, artificial
  Chemically synthesized
ggcccauggacgaggcuca

SEQ ID NO: 238 - RNA, 19 nt, artificial
  Chemically synthesized
gcuggagauuuuuguagau

SEQ ID NO: 239 - RNA, 19 nt, artificial
  Chemically synthesized
agugcuguguauuuccuau

SEQ ID NO: 240 - RNA, 19 nt, artificial
  Chemically synthesized
gggucaucaucagccucuc

SEQ ID NO: 241 - RNA, 19 nt, artificial
  Chemically synthesized
uggcuuaguucauuaggaa

SEQ ID NO: 242 - RNA, 19 nt, artificial
  Chemically synthesized
ugaugacuguacccuuaau

SEQ ID NO: 243 - RNA, 19 nt, artificial
  Chemically synthesized
gauugauuggccagcaaau

SEQ ID NO: 244 - RNA, 19 nt, artificial
  Chemically synthesized
ccuugguauccaagggaau

SEQ ID NO: 245 - RNA, 19 nt, artificial
  Chemically synthesized
gaaucacaguagaaaacag

SEQ ID NO: 246 - RNA, 19 nt, artificial
  Chemically synthesized
ccuuguuuacuuucacaac

SEQ ID NO: 247 - RNA, 19 nt, artificial
  Chemically synthesized
gcauuuguuucuuacagug

SEQ ID NO: 248 - RNA, 19 nt, artificial
  Chemically synthesized
cauuuguuucuuacaguga

SEQ ID NO: 249 - RNA, 19 nt, artificial
  Chemically synthesized
uugucuaguugggaucuuu

SEQ ID NO: 250 - RNA, 19 nt, artificial
  Chemically synthesized
aggauccaaaggagaccua

SEQ ID NO: 251 - RNA, 19 nt, artificial
  Chemically synthesized
cuacguggauguaccguca

SEQ ID NO: 252 - RNA, 19 nt, artificial
  Chemically synthesized
cuuugcucacucugaaaaa

SEQ ID NO: 253 - RNA, 19 nt, artificial
  Chemically synthesized
gaaugcaauaacuacguuu

SEQ ID NO: 254 - RNA, 19 nt, artificial
  Chemically synthesized
cccauugagaaaaaagcca

SEQ ID NO: 255 - RNA, 19 nt, artificial
  Chemically synthesized
caauucagaauguaaguca

SEQ ID NO: 256 - RNA, 19 nt, artificial
  Chemically synthesized
ucuuugugcuuucugaaaa

SEQ ID NO: 257 - RNA, 19 nt, artificial
  Chemically synthesized
caaucaggcuucucugucu

SEQ ID NO: 258 - RNA, 19 nt, artificial
  Chemically synthesized
gaguuaaaagaaucacagu

SEQ ID NO: 259 - RNA, 19 nt, artificial
  Chemically synthesized
gccacaaaacugucuuugu

SEQ ID NO: 260 - RNA, 19 nt, artificial
  Chemically synthesized
gaauuaacacaauagagga

SEQ ID NO: 261 - RNA, 19 nt, artificial
  Chemically synthesized
ugguccaggagcuggagaa

SEQ ID NO: 262 - RNA, 19 nt, artificial
  Chemically synthesized
ugugaauuccucuccuuca

SEQ ID NO: 263 - RNA, 19 nt, artificial
  Chemically synthesized
ggugcugacauccaaugga

SEQ ID NO: 264 - RNA, 19 nt, artificial
  Chemically synthesized
cuguacccuuaauggaguu

SEQ ID NO: 265 - RNA, 19 nt, artificial
  Chemically synthesized
gaugcuucagaucuacaga

SEQ ID NO: 266 - RNA, 19 nt, artificial
  Chemically synthesized
acucauuucacacacugaa

SEQ ID NO: 267 - RNA, 19 nt, artificial
  Chemically synthesized
cuacagagcuaugagccaa

SEQ ID NO: 268 - RNA, 19 nt, artificial
  Chemically synthesized
cacacgaauacacagugua

SEQ ID NO: 269 - RNA, 19 nt, artificial
  Chemically synthesized
ugacuucauggaugcagaa

SEQ ID NO: 270 - RNA, 19 nt, artificial
  Chemically synthesized
ucuuaaacuuacugggaaa

SEQ ID NO: 271 - RNA, 19 nt, artificial
  Chemically synthesized
uacuggguggagaaccuua

SEQ ID NO: 272 - RNA, 19 nt, artificial
  Chemically synthesized
ugacauccaauggaauuaa

SEQ ID NO: 273 - RNA, 19 nt, artificial
  Chemically synthesized
ggaguucucccaguguuug

SEQ ID NO: 274 - RNA, 19 nt, artificial
  Chemically synthesized
gcaggauccucguggauau

SEQ ID NO: 275 - RNA, 19 nt, artificial
  Chemically synthesized
auugaaaagagccacaaaa

SEQ ID NO: 276 - RNA, 19 nt, artificial
  Chemically synthesized
uacccauguuacuaguauu

SEQ ID NO: 277 - RNA, 19 nt, artificial
  Chemically synthesized
ugcuauuccuagaaaaaag

SEQ ID NO: 278 - RNA, 19 nt, artificial
  Chemically synthesized
ggaugcagaacccauggau

SEQ ID NO: 279 - RNA, 19 nt, artificial
  Chemically synthesized
gcacaaaugaacuuaagau

SEQ ID NO: 280 - RNA, 19 nt, artificial
  Chemically synthesized
gccaaaaggaagcccagga

SEQ ID NO: 281 - RNA, 19 nt, artificial
  Chemically synthesized
cuucauuugcuccugugaa

SEQ ID NO: 282 - RNA, 19 nt, artificial
  Chemically synthesized
ggaaggauuuuggguaaau

SEQ ID NO: 283 - RNA, 19 nt, artificial
  Chemically synthesized
caccgaugaaaguuuguuu

SEQ ID NO: 284 - RNA, 19 nt, artificial
  Chemically synthesized
uucuggagcccauugagaa

SEQ ID NO: 285 - RNA, 19 nt, artificial
  Chemically synthesized
gcaaauccugagaguggga

SEQ ID NO: 286 - RNA, 19 nt, artificial
  Chemically synthesized
aaccaugaucauaagucua

SEQ ID NO: 287 - RNA, 19 nt, artificial
  Chemically synthesized
ccugggcagucuugaacau

SEQ ID NO: 288 - RNA, 19 nt, artificial
  Chemically synthesized
cugugguauaugaaaauga

SEQ ID NO: 289 - RNA, 19 nt, artificial
  Chemically synthesized
accggagagacuuugcuca

SEQ ID NO: 290 - RNA, 19 nt, artificial
  Chemically synthesized
aaugguaucugcaagggca

SEQ ID NO: 291 - RNA, 19 nt, artificial
  Chemically synthesized
ccgcaacucaaagaacuuu

SEQ ID NO: 292 - RNA, 19 nt, artificial
  Chemically synthesized
ugaauuugccgcaacucaa

SEQ ID NO: 293 - RNA, 19 nt, artificial
  Chemically synthesized
aggagcuggagaacuucaa

SEQ ID NO: 294 - RNA, 19 nt, artificial
  Chemically synthesized
cucacagaagcuguaaaaa

SEQ ID NO: 295 - RNA, 19 nt, artificial
  Chemically synthesized
acuggguggagaaccuuau

SEQ ID NO: 296 - RNA, 19 nt, artificial
  Chemically synthesized
cacaaaaggcauucucugu

SEQ ID NO: 297 - RNA, 19 nt, artificial
  Chemically synthesized
ucaucaucagccucuccaa

SEQ ID NO: 298 - RNA, 19 nt, artificial
  Chemically synthesized
cuacguuuucuaaggagca

SEQ ID NO: 299 - RNA, 19 nt, artificial
  Chemically synthesized
cagaacccauggauauaga

SEQ ID NO: 300 - RNA, 19 nt, artificial
  Chemically synthesized
aguugguaauuuuagagca

SEQ ID NO: 301 - RNA, 19 nt, artificial
  Chemically synthesized
ugaugguugaagaauacuu

SEQ ID NO: 302 - RNA, 19 nt, artificial
  Chemically synthesized
ccucguggauaucaaaauu

SEQ ID NO: 303 - RNA, 19 nt, artificial
  Chemically synthesized
agugaguggugcaaguaug

SEQ ID NO: 304 - RNA, 19 nt, artificial
  Chemically synthesized
cacuggugaaacaaauuca

SEQ ID NO: 305 - RNA, 19 nt, artificial
  Chemically synthesized
ucugguuccuuguuuacuu

SEQ ID NO: 306 - RNA, 19 nt, artificial
  Chemically synthesized
augccuacuggguggagaa

SEQ ID NO: 307 - RNA, 19 nt, artificial
  Chemically synthesized
cagucuuugucuaguuggg

SEQ ID NO: 308 - RNA, 19 nt, artificial
  Chemically synthesized
ggaagaauccuccaaucag

SEQ ID NO: 309 - RNA, 19 nt, artificial
  Chemically synthesized
cguggauguaccgucauuu

SEQ ID NO: 310 - RNA, 19 nt, artificial
  Chemically synthesized
aaaaaaccggagagacuuu

SEQ ID NO: 311 - RNA, 19 nt, artificial
  Chemically synthesized
uuggcaucauuggaaaaaa

SEQ ID NO: 312 - RNA, 19 nt, artificial
  Chemically synthesized
caauaucauugacuccauu

SEQ ID NO: 313 - RNA, 19 nt, artificial
  Chemically synthesized
aaaucugagagcugcgaua

SEQ ID NO: 314 - RNA, 19 nt, artificial
  Chemically synthesized
agcaucugauaaugacaga

SEQ ID NO: 315 - RNA, 19 nt, artificial
  Chemically synthesized
aggagcucuuagugaccaa

SEQ ID NO: 316 - RNA, 19 nt, artificial
  Chemically synthesized
ggcauucucuguccuaccu

SEQ ID NO: 317 - RNA, 19 nt, artificial
  Chemically synthesized
gucaucugauccuucauau

SEQ ID NO: 318 - RNA, 19 nt, artificial
  Chemically synthesized
gaggcagcgagaaagcgca

SEQ ID NO: 319 - RNA, 19 nt, artificial
  Chemically synthesized
guaacaggcugcauuccca

SEQ ID NO: 320 - RNA, 19 nt, artificial
  Chemically synthesized
cauuagcaacagugaccua

SEQ ID NO: 321 - RNA, 19 nt, artificial
  Chemically synthesized
cauacuuuguggauggugu

SEQ ID NO: 322 - RNA, 19 nt, artificial
  Chemically synthesized
cggaagauaaugaacacca

SEQ ID NO: 323 - RNA, 19 nt, artificial
  Chemically synthesized
cagcugaucucaagagcaa

SEQ ID NO: 324 - RNA, 19 nt, artificial
  Chemically synthesized
ggugcuguuuuauaaacau

SEQ ID NO: 325 - RNA, 19 nt, artificial
  Chemically synthesized
ugaucugagcacuuuauau

SEQ ID NO: 326 - RNA, 19 nt, artificial
  Chemically synthesized
ucaagagcaacaaggcaaa

SEQ ID NO: 327 - RNA, 19 nt, artificial
  Chemically synthesized
cucccauuuccgucuuuuu

SEQ ID NO: 328 - RNA, 19 nt, artificial
  Chemically synthesized
agauaaccaugaucauaag

SEQ ID NO: 329 - RNA, 19 nt, artificial
  Chemically synthesized
gacuugcuuacuaaaacua

SEQ ID NO: 330 - RNA, 19 nt, artificial
  Chemically synthesized
ggaucuuuaaacuccauuc

SEQ ID NO: 331 - RNA, 19 nt, artificial
  Chemically synthesized
ugcucacucugaaaaacuu

SEQ ID NO: 332 - RNA, 19 nt, artificial
  Chemically synthesized
gucaguggccagaaaagau

SEQ ID NO: 333 - RNA, 19 nt, artificial
  Chemically synthesized
uggagauuuuuguagaugu

SEQ ID NO: 334 - RNA, 19 nt, artificial
  Chemically synthesized
ggcugcauucccaagacac

SEQ ID NO: 335 - RNA, 19 nt, artificial
  Chemically synthesized
agaauacuuggaucucagu

SEQ ID NO: 336 - RNA, 19 nt, artificial
  Chemically synthesized
gcagucuugaacauuuaga

SEQ ID NO: 337 - RNA, 19 nt, artificial
  Chemically synthesized
uggaucucagugaaaauuu

SEQ ID NO: 338 - RNA, 19 nt, artificial
  Chemically synthesized
auuuaagaccagucuuugu

SEQ ID NO: 339 - RNA, 19 nt, artificial
  Chemically synthesized
ucacaguagaaaacaguaa

SEQ ID NO: 340 - RNA, 19 nt, artificial
  Chemically synthesized
gguggagaaccuuaugguc

SEQ ID NO: 341 - RNA, 19 nt, artificial
  Chemically synthesized
caccuacauuagcaacagu

SEQ ID NO: 342 - RNA, 19 nt, artificial
  Chemically synthesized
accgcaaugguaucugcaa

SEQ ID NO: 343 - RNA, 19 nt, artificial
  Chemically synthesized
agucaauucagaauguaag

SEQ ID NO: 344 - RNA, 19 nt, artificial
  Chemically synthesized
aguugggaucuuuauguca

SEQ ID NO: 345 - RNA, 19 nt, artificial
  Chemically synthesized
cauucuucuggagcccauu

SEQ ID NO: 346 - RNA, 19 nt, artificial
  Chemically synthesized
cuuguugcuauuccuagaa

SEQ ID NO: 347 - RNA, 19 nt, artificial
  Chemically synthesized
cucugucuugugaccgcaa

SEQ ID NO: 348 - RNA, 19 nt, artificial
  Chemically synthesized
gaggacuugcuuacuaaaa

SEQ ID NO: 349 - RNA, 19 nt, artificial
  Chemically synthesized
auccaauggaauuaacaca

SEQ ID NO: 350 - RNA, 19 nt, artificial
  Chemically synthesized
cuaugaugcauuuguuucu

SEQ ID NO: 351 - RNA, 19 nt, artificial
  Chemically synthesized
gccugaaacuugucagugg

SEQ ID NO: 352 - RNA, 19 nt, artificial
  Chemically synthesized
cugcaagcugcggaagaua

SEQ ID NO: 353 - RNA, 19 nt, artificial
  Chemically synthesized
gggaauugguugcaggauc

SEQ ID NO: 354 - RNA, 19 nt, artificial
  Chemically synthesized
agguaaaguggaaacguua

SEQ ID NO: 355 - RNA, 19 nt, artificial
  Chemically synthesized
gaacugcgagauacugauu

SEQ ID NO: 356 - RNA, 19 nt, artificial
  Chemically synthesized
gaacauuuagacuuauccu

SEQ ID NO: 357 - RNA, 19 nt, artificial
  Chemically synthesized
aucacaguagaaaacagua

SEQ ID NO: 358 - RNA, 19 nt, artificial
  Chemically synthesized
ccaguguuugguguugcaa

SEQ ID NO: 359 - RNA, 19 nt, artificial
  Chemically synthesized
gaguggugcaaguaugaac

SEQ ID NO: 360 - RNA, 19 nt, artificial
  Chemically synthesized
caguguuugguguugcaag

SEQ ID NO: 361 - RNA, 19 nt, artificial
  Chemically synthesized
gugcuguguauuuccuauu

SEQ ID NO: 362 - RNA, 19 nt, artificial
  Chemically synthesized
caguggccagaaaagauga

SEQ ID NO: 363 - RNA, 19 nt, artificial
  Chemically synthesized
cauucuaugccugaaacuu

SEQ ID NO: 364 - RNA, 19 nt, artificial
  Chemically synthesized
uucacacacugaagacuuu

SEQ ID NO: 365 - RNA, 19 nt, artificial
  Chemically synthesized
uccugagagugggaaauau

SEQ ID NO: 366 - RNA, 19 nt, artificial
  Chemically synthesized
gcgauaaaguccuagguuc

SEQ ID NO: 367 - RNA, 19 nt, artificial
  Chemically synthesized
cugguaguuguggguugaa

SEQ ID NO: 368 - RNA, 19 nt, artificial
  Chemically synthesized
aggagcaacuugacucauu

SEQ ID NO: 369 - RNA, 19 nt, artificial
  Chemically synthesized
ccaaagucuugauugauug

SEQ ID NO: 370 - RNA, 19 nt, artificial
  Chemically synthesized
cuuaauggaguugguaauu

SEQ ID NO: 371 - RNA, 19 nt, artificial
  Chemically synthesized
cauucccaagacacuggaa

SEQ ID NO: 372 - RNA, 19 nt, artificial
  Chemically synthesized
cauuagaauacuuggaucu

SEQ ID NO: 373 - RNA, 19 nt, artificial
  Chemically synthesized
uccuuguuuacuuucacaa

SEQ ID NO: 374 - RNA, 19 nt, artificial
  Chemically synthesized
ccacaguugguugacuuca

SEQ ID NO: 375 - RNA, 19 nt, artificial
  Chemically synthesized
gccucucggugucggaaug

SEQ ID NO: 376 - RNA, 19 nt, artificial
  Chemically synthesized
caauagaggaagauucuuu

SEQ ID NO: 377 - RNA, 19 nt, artificial
  Chemically synthesized
agccuugaccuguccaaca

SEQ ID NO: 378 - RNA, 19 nt, artificial
  Chemically synthesized
ugaggaacuugagauugau

SEQ ID NO: 379 - RNA, 19 nt, artificial
  Chemically synthesized
caggagcuggagaacuuca

SEQ ID NO: 380 - RNA, 19 nt, artificial
  Chemically synthesized
uggccaaagucuugauuga

SEQ ID NO: 381 - RNA, 19 nt, artificial
  Chemically synthesized
gacuuaccuuccuugagga

SEQ ID NO: 382 - RNA, 19 nt, artificial
  Chemically synthesized
gguaguuguggguugaagc

SEQ ID NO: 383 - RNA, 19 nt, artificial
  Chemically synthesized
ugcuggagauuuuuguaga

SEQ ID NO: 384 - RNA, 19 nt, artificial
  Chemically synthesized
gaagcugguggcaauaacu

SEQ ID NO: 385 - RNA, 19 nt, artificial
  Chemically synthesized
cccauuuccgucuuuuuga

SEQ ID NO: 386 - RNA, 19 nt, artificial
  Chemically synthesized
agccucuccaaggaagaau

SEQ ID NO: 387 - RNA, 19 nt, artificial
  Chemically synthesized
agggcucacagaagcugua

SEQ ID NO: 388 - RNA, 19 nt, artificial
  Chemically synthesized
aaaacuuugugaagaguga

SEQ ID NO: 389 - RNA, 19 nt, artificial
  Chemically synthesized
acuguaaucuguagcaacu

SEQ ID NO: 390 - RNA, 19 nt, artificial
  Chemically synthesized
auauuuuacugcuggagau

SEQ ID NO: 391 - RNA, 19 nt, artificial
  Chemically synthesized
cuaccuagcugucacuucu

SEQ ID NO: 392 - RNA, 19 nt, artificial
  Chemically synthesized
agucaucugauccuucaua

SEQ ID NO: 393 - RNA, 19 nt, artificial
  Chemically synthesized
gaauguaagucaucugauc

SEQ ID NO: 394 - RNA, 19 nt, artificial
  Chemically synthesized
gcccauugcucuuucacug

SEQ ID NO: 395 - RNA, 19 nt, artificial
  Chemically synthesized
uccaauggaauuaacacaa

SEQ ID NO: 396 - RNA, 19 nt, artificial
  Chemically synthesized
gaagaauccuccaaucagg

SEQ ID NO: 397 - RNA, 19 nt, artificial
  Chemically synthesized
gauccucguggauaucaaa

SEQ ID NO: 398 - RNA, 19 nt, artificial
  Chemically synthesized
gauacugauuuggacacuu

SEQ ID NO: 399 - RNA, 19 nt, artificial
  Chemically synthesized
ccauuuccgucuuuuugau

SEQ ID NO: 400 - RNA, 19 nt, artificial
  Chemically synthesized
ggagagacuuugcucacuc

SEQ ID NO: 401 - RNA, 19 nt, artificial
  Chemically synthesized
cuucacuaagauucaaaga

SEQ ID NO: 402 - RNA, 19 nt, artificial
  Chemically synthesized
gguugacuucauggaugca

SEQ ID NO: 403 - RNA, 19 nt, artificial
  Chemically synthesized
cuuugaauuugccgcaacu

SEQ ID NO: 404 - RNA, 19 nt, artificial
  Chemically synthesized
accaugaucauaagucuau

SEQ ID NO: 405 - RNA, 19 nt, artificial
  Chemically synthesized
cuugguauccaagggaauu

SEQ ID NO: 406 - RNA, 19 nt, artificial
  Chemically synthesized
cuuaguucauuaggaaaca

SEQ ID NO: 407 - RNA, 19 nt, artificial
  Chemically synthesized
guuacaaguuccguggaau

SEQ ID NO: 408 - RNA, 19 nt, artificial
  Chemically synthesized
ggcaaaaucauuuggcauc

SEQ ID NO: 409 - RNA, 19 nt, artificial
  Chemically synthesized
agauguuagcaacaacaau

SEQ ID NO: 410 - RNA, 19 nt, artificial
  Chemically synthesized
gaaaaaagugcuguguauu

SEQ ID NO: 411 - RNA, 19 nt, artificial
  Chemically synthesized
guugguaauuuuagagcau

SEQ ID NO: 412 - RNA, 19 nt, artificial
  Chemically synthesized
cgccucucggugucggaau

SEQ ID NO: 413 - RNA, 19 nt, artificial
  Chemically synthesized
cauugcucuuucacugcuu

SEQ ID NO: 414 - RNA, 19 nt, artificial
  Chemically synthesized
agaauuagaguuugaugac

SEQ ID NO: 415 - RNA, 19 nt, artificial
  Chemically synthesized
ggccaaagucuugauugau

SEQ ID NO: 416 - RNA, 19 nt, artificial
  Chemically synthesized
ggaauguuuggaacugcga

SEQ ID NO: 417 - RNA, 19 nt, artificial
  Chemically synthesized
caauccggaggcugcauau

SEQ ID NO: 418 - RNA, 19 nt, artificial
  Chemically synthesized
aggcucagcgggaaggauu

SEQ ID NO: 419 - RNA, 19 nt, artificial
  Chemically synthesized
gcuauuccuagaaaaaagu

SEQ ID NO: 420 - RNA, 19 nt, artificial
  Chemically synthesized
ggcagucuugaacauuuag

SEQ ID NO: 421 - RNA, 19 nt, artificial
  Chemically synthesized
acagcacaaaugaacuuaa

SEQ ID NO: 422 - RNA, 19 nt, artificial
  Chemically synthesized
cauuggaaaaaaccggaga

SEQ ID NO: 423 - RNA, 19 nt, artificial
  Chemically synthesized
gcacacgaauacacagugu

SEQ ID NO: 424 - RNA, 19 nt, artificial
  Chemically synthesized
agaccuauagugacuccca

SEQ ID NO: 425 - RNA, 19 nt, artificial
  Chemically synthesized
ggauguaccgucauuugag

SEQ ID NO: 426 - RNA, 19 nt, artificial
  Chemically synthesized
ugggaaauauggacaccuu

SEQ ID NO: 427 - RNA, 19 nt, artificial
  Chemically synthesized
aguggugcaaguaugaacu

SEQ ID NO: 428 - RNA, 19 nt, artificial
  Chemically synthesized
ugcugacauccaauggaau

SEQ ID NO: 429 - RNA, 19 nt, artificial
  Chemically synthesized
ggcaugugcugugcucugu

SEQ ID NO: 430 - RNA, 19 nt, artificial
  Chemically synthesized
agaaucacaguagaaaaca

SEQ ID NO: 431 - RNA, 19 nt, artificial
  Chemically synthesized
cuucuggagcccauugaga

SEQ ID NO: 432 - RNA, 19 nt, artificial
  Chemically synthesized
cucggaguucucccagugu

SEQ ID NO: 433 - RNA, 19 nt, artificial
  Chemically synthesized
acaccaagaccuaccugga

SEQ ID NO: 434 - RNA, 19 nt, artificial
  Chemically synthesized
gagcugcgauaaaguccua

SEQ ID NO: 435 - RNA, 19 nt, artificial
  Chemically synthesized
ccuuccuugaggaacuuga

SEQ ID NO: 436 - RNA, 19 nt, artificial
  Chemically synthesized
gaccuacagagguguguga

SEQ ID NO: 437 - RNA, 19 nt, artificial
  Chemically synthesized
aucugagagcugcgauaaa

SEQ ID NO: 438 - RNA, 19 nt, artificial
  Chemically synthesized
ucugauaaugacagaguua

SEQ ID NO: 439 - RNA, 19 nt, artificial
  Chemically synthesized
aaucaguaggaaugcaaua

SEQ ID NO: 440 - RNA, 19 nt, artificial
  Chemically synthesized
gagcccauugagaaaaaag

SEQ ID NO: 441 - RNA, 19 nt, artificial
  Chemically synthesized
uuaugaucugagcacuuua

SEQ ID NO: 442 - RNA, 19 nt, artificial
  Chemically synthesized
acagagcuaugagccaaaa

SEQ ID NO: 443 - RNA, 19 nt, artificial
  Chemically synthesized
cuuuuugaugagaacaaug

SEQ ID NO: 444 - RNA, 19 nt, artificial
  Chemically synthesized
gcucggaguucucccagug

SEQ ID NO: 445 - RNA, 19 nt, artificial
  Chemically synthesized
gggaaauccuuacaaaacc

SEQ ID NO: 446 - RNA, 19 nt, artificial
  Chemically synthesized
ugaagucaauucagaaugu

SEQ ID NO: 447 - RNA, 19 nt, artificial
  Chemically synthesized
acguggauguaccgucauu

SEQ ID NO: 448 - RNA, 19 nt, artificial
  Chemically synthesized
uuucuaaggagcaacuuga

SEQ ID NO: 449 - RNA, 19 nt, artificial
  Chemically synthesized
ccuucacuaagauucaaag

SEQ ID NO: 450 - RNA, 19 nt, artificial
  Chemically synthesized
acugguaguuguggguuga

SEQ ID NO: 451 - RNA, 19 nt, artificial
  Chemically synthesized
aaauccugagagugggaaa

SEQ ID NO: 452 - RNA, 19 nt, artificial
  Chemically synthesized
ggagaaccuuaugguccag

SEQ ID NO: 453 - RNA, 19 nt, artificial
  Chemically synthesized
aauacuuggaucucaguga

SEQ ID NO: 454 - RNA, 19 nt, artificial
  Chemically synthesized
gcauucucuguccuaccua

SEQ ID NO: 455 - RNA, 19 nt, artificial
  Chemically synthesized
ccauucucauucuucugga

SEQ ID NO: 456 - RNA, 19 nt, artificial
  Chemically synthesized
gaaucagauuucuggauug

SEQ ID NO: 457 - RNA, 19 nt, artificial
  Chemically synthesized
ugaugagaacaaugaugcu

SEQ ID NO: 458 - RNA, 19 nt, artificial
  Chemically synthesized
ugaauauagucccuuggua

SEQ ID NO: 459 - RNA, 19 nt, artificial
  Chemically synthesized
cguuuucuaaggagcaacu

SEQ ID NO: 460 - RNA, 19 nt, artificial
  Chemically synthesized
uucccaagacacuggaaau

SEQ ID NO: 461 - RNA, 19 nt, artificial
  Chemically synthesized
agauccagguaaaguggaa

SEQ ID NO: 462 - RNA, 19 nt, artificial
  Chemically synthesized
ugcauauuccaagguuuua

SEQ ID NO: 463 - RNA, 19 nt, artificial
  Chemically synthesized
cagucuugaacauuuagac

SEQ ID NO: 464 - RNA, 19 nt, artificial
  Chemically synthesized
ccgaugaaaguuuguuuca

SEQ ID NO: 465 - RNA, 19 nt, artificial
  Chemically synthesized
gacugugucauucuuucuu

SEQ ID NO: 466 - RNA, 19 nt, artificial
  Chemically synthesized
cuucauaagcgggacuuca

SEQ ID NO: 467 - RNA, 19 nt, artificial
  Chemically synthesized
uuuucugguuccuuguuua

SEQ ID NO: 468 - RNA, 19 nt, artificial
  Chemically synthesized
ccuucauaugaagcagcau

SEQ ID NO: 469 - RNA, 19 nt, artificial
  Chemically synthesized
ucauugacuccauugaaaa

SEQ ID NO: 470 - RNA, 19 nt, artificial
  Chemically synthesized
ccugagagugggaaauaug

SEQ ID NO: 471 - RNA, 19 nt, artificial
  Chemically synthesized
aucaguaggaaugcaauaa

SEQ ID NO: 472 - RNA, 19 nt, artificial
  Chemically synthesized
augagauaaccaugaucau

SEQ ID NO: 473 - RNA, 19 nt, artificial
  Chemically synthesized
cauauuuuacugcuggaga

SEQ ID NO: 474 - RNA, 19 nt, artificial
  Chemically synthesized
uccuagguucccauauuua

SEQ ID NO: 475 - RNA, 19 nt, artificial
  Chemically synthesized
cuugugaccgcaaugguau

SEQ ID NO: 476 - RNA, 19 nt, artificial
  Chemically synthesized
acaauaucauugacuccau

SEQ ID NO: 477 - RNA, 19 nt, artificial
  Chemically synthesized
cucuguuccugcugauccu

SEQ ID NO: 478 - RNA, 19 nt, artificial
  Chemically synthesized
aggcaaaaucauuuggcau

SEQ ID NO: 479 - RNA, 19 nt, artificial
  Chemically synthesized
ucagauuucuggauuguua

SEQ ID NO: 480 - RNA, 19 nt, artificial
  Chemically synthesized
gugugacucuccaucccau

SEQ ID NO: 481 - RNA, 19 nt, artificial
  Chemically synthesized
cauucucuguccuaccuag

SEQ ID NO: 482 - RNA, 19 nt, artificial
  Chemically synthesized
ugaggacuugcuuacuaaa

SEQ ID NO: 483 - RNA, 19 nt, artificial
  Chemically synthesized
ggguaaaucugagagcugc

SEQ ID NO: 484 - RNA, 19 nt, artificial
  Chemically synthesized
ugcuaugaugcauuuguuu

SEQ ID NO: 485 - RNA, 19 nt, artificial
  Chemically synthesized
agcauauuuuacugcugga

SEQ ID NO: 486 - RNA, 19 nt, artificial
  Chemically synthesized
aguaggaaugcaauaacua

SEQ ID NO: 487 - RNA, 19 nt, artificial
  Chemically synthesized
aacuuauccagcacacgaa

SEQ ID NO: 488 - RNA, 19 nt, artificial
  Chemically synthesized
gcgagauacugauuuggac

SEQ ID NO: 489 - RNA, 19 nt, artificial
  Chemically synthesized
aaggcaaaaucauuuggca

SEQ ID NO: 490 - RNA, 19 nt, artificial
  Chemically synthesized
ccguggaauguuuggaacu

SEQ ID NO: 491 - RNA, 19 nt, artificial
  Chemically synthesized
cuuugucuaguugggaucu

SEQ ID NO: 492 - RNA, 19 nt, artificial
  Chemically synthesized
agaggugugugaaccucca

SEQ ID NO: 493 - RNA, 19 nt, artificial
  Chemically synthesized
cagaauguaagucaucuga

SEQ ID NO: 494 - RNA, 19 nt, artificial
  Chemically synthesized
cucacucugaaaaacuuga

SEQ ID NO: 495 - RNA, 19 nt, artificial
  Chemically synthesized
cuaugagccaaaaaguuug

SEQ ID NO: 496 - RNA, 19 nt, artificial
  Chemically synthesized
cuuucugaaaacuuuguga

SEQ ID NO: 497 - RNA, 19 nt, artificial
  Chemically synthesized
ggcguucucucaggugacu

SEQ ID NO: 498 - RNA, 19 nt, artificial
  Chemically synthesized
uccaggagcuggagaacuu

SEQ ID NO: 499 - RNA, 19 nt, artificial
  Chemically synthesized
gugucggaaugucacagga

SEQ ID NO: 500 - RNA, 19 nt, artificial
  Chemically synthesized
uucacuuacagaaagaguu

SEQ ID NO: 501 - RNA, 19 nt, artificial
  Chemically synthesized
aggaaacagcacaaaugaa

SEQ ID NO: 502 - RNA, 19 nt, artificial
  Chemically synthesized
uuccuuguuuacuuucaca

SEQ ID NO: 503 - RNA, 19 nt, artificial
  Chemically synthesized
gugaagagugaguggugca

SEQ ID NO: 504 - RNA, 19 nt, artificial
  Chemically synthesized
ucucaaugacugugucauu

SEQ ID NO: 505 - RNA, 19 nt, artificial
  Chemically synthesized
auuuggcaucauuggaaaa

SEQ ID NO: 506 - RNA, 19 nt, artificial
  Chemically synthesized
caacuguaaucuguagcaa

SEQ ID NO: 507 - RNA, 19 nt, artificial
  Chemically synthesized
gcugaucucaagagcaaca

SEQ ID NO: 508 - RNA, 19 nt, artificial
  Chemically synthesized
uggccugugguauaugaaa

SEQ ID NO: 509 - RNA, 19 nt, artificial
  Chemically synthesized
ucuaugagauaaccaugau

SEQ ID NO: 510 - RNA, 19 nt, artificial
  Chemically synthesized
ggcucauugugcccauugc

SEQ ID NO: 511 - RNA, 19 nt, artificial
  Chemically synthesized
guggcaauaacuucauuug

SEQ ID NO: 512 - RNA, 19 nt, artificial
  Chemically synthesized
guuccuuguuuacuuucac

SEQ ID NO: 513 - RNA, 19 nt, artificial
  Chemically synthesized
acauccaauggaauuaaca

SEQ ID NO: 514 - RNA, 19 nt, artificial
  Chemically synthesized
caaguugugucuucauaag

SEQ ID NO: 515 - RNA, 19 nt, artificial
  Chemically synthesized
cuuugugcuuucugaaaac

SEQ ID NO: 516 - RNA, 19 nt, artificial
  Chemically synthesized
agcaacuugacucauuuca

SEQ ID NO: 517 - RNA, 19 nt, artificial
  Chemically synthesized
gcagcugaucucaagagca

SEQ ID NO: 518 - RNA, 19 nt, artificial
  Chemically synthesized
gcuucagaucuacagagcu

SEQ ID NO: 519 - RNA, 19 nt, artificial
  Chemically synthesized
gauccacaguugguugacu

SEQ ID NO: 520 - RNA, 19 nt, artificial
  Chemically synthesized
agaauguaagucaucugau

SEQ ID NO: 521 - RNA, 19 nt, artificial
  Chemically synthesized
uggacaccuucacuaagau

SEQ ID NO: 522 - RNA, 19 nt, artificial
  Chemically synthesized
cugccauucucauucuucu

SEQ ID NO: 523 - RNA, 19 nt, artificial
  Chemically synthesized
agaacaaugaugcugccau

SEQ ID NO: 524 - RNA, 19 nt, artificial
  Chemically synthesized
aaggagaccuauagugacu

SEQ ID NO: 525 - RNA, 19 nt, artificial
  Chemically synthesized
guauugaaaaucaguagga

SEQ ID NO: 526 - RNA, 19 nt, artificial
  Chemically synthesized
aggaagaauccuccaauca

SEQ ID NO: 527 - RNA, 19 nt, artificial
  Chemically synthesized
ccuccaaucaggcuucucu

SEQ ID NO: 528 - RNA, 19 nt, artificial
  Chemically synthesized
uacuuggaucucagugaaa

SEQ ID NO: 529 - RNA, 19 nt, artificial
  Chemically synthesized
uguuuggaacugcgagaua

SEQ ID NO: 530 - RNA, 19 nt, artificial
  Chemically synthesized
aaucugagagcugcgauaa

SEQ ID NO: 531 - RNA, 19 nt, artificial
  Chemically synthesized
gcucuggugcugacaucca

SEQ ID NO: 532 - RNA, 19 nt, artificial
  Chemically synthesized
cuucaaguugugucuucau

SEQ ID NO: 533 - RNA, 19 nt, artificial
  Chemically synthesized
caucagccucuccaaggaa

SEQ ID NO: 534 - RNA, 19 nt, artificial
  Chemically synthesized
gcaugugcugugcucuguu

SEQ ID NO: 535 - RNA, 19 nt, artificial
  Chemically synthesized
ccgcaaugguaucugcaag

SEQ ID NO: 536 - RNA, 19 nt, artificial
  Chemically synthesized
gugcuuucugaaaacuuug

SEQ ID NO: 537 - RNA, 19 nt, artificial
  Chemically synthesized
ggcggcugcucggcguucu

SEQ ID NO: 538 - RNA, 19 nt, artificial
  Chemically synthesized
caggugacugcucggaguu

SEQ ID NO: 539 - RNA, 19 nt, artificial
  Chemically synthesized
uugacuucauggaugcaga

SEQ ID NO: 540 - RNA, 19 nt, artificial
  Chemically synthesized
ccauggauauagagggcca

SEQ ID NO: 541 - RNA, 19 nt, artificial
  Chemically synthesized
augcagaacccauggauau

SEQ ID NO: 542 - RNA, 19 nt, artificial
  Chemically synthesized
gaaaaucaguaggaaugca

SEQ ID NO: 543 - RNA, 19 nt, artificial
  Chemically synthesized
acaucugcuaugaugcauu

SEQ ID NO: 544 - RNA, 19 nt, artificial
  Chemically synthesized
auccacaguugguugacuu

SEQ ID NO: 545 - RNA, 19 nt, artificial
  Chemically synthesized
aacuggacuucucccauuu

SEQ ID NO: 546 - RNA, 19 nt, artificial
  Chemically synthesized
uccgucuuuuugaugagaa

SEQ ID NO: 547 - RNA, 19 nt, artificial
  Chemically synthesized
ugguaauuuuagagcaucu

SEQ ID NO: 548 - RNA, 19 nt, artificial
  Chemically synthesized
ggaaacaucucuuuuuucu

SEQ ID NO: 549 - RNA, 19 nt, artificial
  Chemically synthesized
uacagagcuaugagccaaa

SEQ ID NO: 550 - RNA, 19 nt, artificial
  Chemically synthesized
augguugaagaauacuuga

SEQ ID NO: 551 - RNA, 19 nt, artificial
  Chemically synthesized
agcacaaaugaacuuaaga

SEQ ID NO: 552 - RNA, 19 nt, artificial
  Chemically synthesized
cccauauuuaagaccaguc

SEQ ID NO: 553 - RNA, 19 nt, artificial
  Chemically synthesized
ccugcuaagagacuccucu

SEQ ID NO: 554 - RNA, 19 nt, artificial
  Chemically synthesized
ugagcacuuuauauucacu

SEQ ID NO: 555 - RNA, 19 nt, artificial
  Chemically synthesized
gcacuuuauauucacuuac

SEQ ID NO: 556 - RNA, 19 nt, artificial
  Chemically synthesized
auuagaguuugaugacugu

SEQ ID NO: 557 - RNA, 19 nt, artificial
  Chemically synthesized
gaauccuccaaucaggcuu

SEQ ID NO: 558 - RNA, 19 nt, artificial
  Chemically synthesized
augugaaaaucaccgauga

SEQ ID NO: 559 - RNA, 19 nt, artificial
  Chemically synthesized
caggauccaaaggagaccu

SEQ ID NO: 560 - RNA, 19 nt, artificial
  Chemically synthesized
guauccaagggaauugguu

SEQ ID NO: 561 - RNA, 19 nt, artificial
  Chemically synthesized
cuuuuuucucaucucacaa

SEQ ID NO: 562 - RNA, 19 nt, artificial
  Chemically synthesized
guaauuuuagagcaucuga

SEQ ID NO: 563 - RNA, 19 nt, artificial
  Chemically synthesized
guuuggaacugcgagauac

SEQ ID NO: 564 - RNA, 19 nt, artificial
  Chemically synthesized
cacugaagacuuuggaagc

SEQ ID NO: 565 - RNA, 19 nt, artificial
  Chemically synthesized
ugcggaagauaaugaacac

SEQ ID NO: 566 - RNA, 19 nt, artificial
  Chemically synthesized
caucugauaaugacagagu

SEQ ID NO: 567 - RNA, 19 nt, artificial
  Chemically synthesized
acaaaauugcaaauccuga

SEQ ID NO: 568 - RNA, 19 nt, artificial
  Chemically synthesized
aauugcaaauccugagagu

SEQ ID NO: 569 - RNA, 19 nt, artificial
  Chemically synthesized
cacuggaaauuuuagaugu

SEQ ID NO: 570 - RNA, 19 nt, artificial
  Chemically synthesized
uacguuuucuaaggagcaa

SEQ ID NO: 571 - RNA, 19 nt, artificial
  Chemically synthesized
accaagaccuaccuggagu

SEQ ID NO: 572 - RNA, 19 nt, artificial
  Chemically synthesized
guugguugacuucauggau

SEQ ID NO: 573 - RNA, 19 nt, artificial
  Chemically synthesized
uucuaugagauaaccauga

SEQ ID NO: 574 - RNA, 19 nt, artificial
  Chemically synthesized
ccagcaggaacaucugcua

SEQ ID NO: 575 - RNA, 19 nt, artificial
  Chemically synthesized
caguaaaguuuuucugguu

SEQ ID NO: 576 - RNA, 19 nt, artificial
  Chemically synthesized
gagcacuuuauauucacuu

SEQ ID NO: 577 - RNA, 19 nt, artificial
  Chemically synthesized
uucauuugcuccugugaau

SEQ ID NO: 578 - RNA, 19 nt, artificial
  Chemically synthesized
accuuaugguccaggagcu

SEQ ID NO: 579 - RNA, 19 nt, artificial
  Chemically synthesized
agaaccuuaugguccagga

SEQ ID NO: 580 - RNA, 19 nt, artificial
  Chemically synthesized
uuuggaagcugguggcaau

SEQ ID NO: 581 - RNA, 19 nt, artificial
  Chemically synthesized
uugaggacuugcuuacuaa

SEQ ID NO: 582 - RNA, 19 nt, artificial
  Chemically synthesized
auacugauuuggacacuuu

SEQ ID NO: 583 - RNA, 19 nt, artificial
  Chemically synthesized
cacaauagaggaagauucu

SEQ ID NO: 584 - RNA, 19 nt, artificial
  Chemically synthesized
cuaguugggaucuuuaugu

SEQ ID NO: 585 - RNA, 19 nt, artificial
  Chemically synthesized
ccauugaaaagagccacaa

SEQ ID NO: 586 - RNA, 19 nt, artificial
  Chemically synthesized
cucauuucacacacugaag

SEQ ID NO: 587 - RNA, 19 nt, artificial
  Chemically synthesized
aaaucaguaggaaugcaau

SEQ ID NO: 588 - RNA, 19 nt, artificial
  Chemically synthesized
agcucuuagugaccaagug

SEQ ID NO: 589 - RNA, 19 nt, artificial
  Chemically synthesized
aguucauuaggaaacagca

SEQ ID NO: 590 - RNA, 19 nt, artificial
  Chemically synthesized
ggacacuuuccauuuuuca

SEQ ID NO: 591 - RNA, 19 nt, artificial
  Chemically synthesized
ccuuucuucuuuaacauuc

SEQ ID NO: 592 - RNA, 19 nt, artificial
  Chemically synthesized
ugauugauuggccagcaaa

SEQ ID NO: 593 - RNA, 19 nt, artificial
  Chemically synthesized
gaacuuauccagcacacga

SEQ ID NO: 594 - RNA, 19 nt, artificial
  Chemically synthesized
acuguacccuuaauggagu

SEQ ID NO: 595 - RNA, 19 nt, artificial
  Chemically synthesized
aagauaaugaacaccaaga

SEQ ID NO: 596 - RNA, 19 nt, artificial
  Chemically synthesized
ccaagaccuaccuggagug

SEQ ID NO: 597 - RNA, 19 nt, artificial
  Chemically synthesized
ucacaaaauugcaaauccu

SEQ ID NO: 598 - RNA, 19 nt, artificial
  Chemically synthesized
ucauuugaggacuugcuua

SEQ ID NO: 599 - RNA, 19 nt, artificial
  Chemically synthesized
ugggaucuuuaugucacua

SEQ ID NO: 600 - RNA, 19 nt, artificial
  Chemically synthesized
gcugcucggcguucucuca

SEQ ID NO: 601 - RNA, 19 nt, artificial
  Chemically synthesized
uccagaaauaaguugauga

SEQ ID NO: 602 - RNA, 19 nt, artificial
  Chemically synthesized
ugugaaaaucaccgaugaa

SEQ ID NO: 603 - RNA, 19 nt, artificial
  Chemically synthesized
ccagucuuugucuaguugg

SEQ ID NO: 604 - RNA, 19 nt, artificial
  Chemically synthesized
agagcuaugagccaaaaag

SEQ ID NO: 605 - RNA, 19 nt, artificial
  Chemically synthesized
uaaccaugaucauaagucu

SEQ ID NO: 606 - RNA, 19 nt, artificial
  Chemically synthesized
gugaauuccucuccuucac

SEQ ID NO: 607 - RNA, 19 nt, artificial
  Chemically synthesized
gguauaugaaaaugaugug

SEQ ID NO: 608 - RNA, 19 nt, artificial
  Chemically synthesized
ccuucacucaggagcagca

SEQ ID NO: 609 - RNA, 19 nt, artificial
  Chemically synthesized
cuugaccuguccaacaaca

SEQ ID NO: 610 - RNA, 19 nt, artificial
  Chemically synthesized
cuggugaaacaaauucauu

SEQ ID NO: 611 - RNA, 19 nt, artificial
  Chemically synthesized
agagugaguggugcaagua

SEQ ID NO: 612 - RNA, 19 nt, artificial
  Chemically synthesized
uggccagaaaagaugaaau

SEQ ID NO: 613 - RNA, 19 nt, artificial
  Chemically synthesized
ccaacuguaaucuguagca

SEQ ID NO: 614 - RNA, 19 nt, artificial
  Chemically synthesized
acuucucugugcagcugau

SEQ ID NO: 615 - RNA, 19 nt, artificial
  Chemically synthesized
ugguggcaauaacuucauu

SEQ ID NO: 616 - RNA, 19 nt, artificial
  Chemically synthesized
ucauuuggcaucauuggaa

SEQ ID NO: 617 - RNA, 19 nt, artificial
  Chemically synthesized
cuggguggagaaccuuaug

SEQ ID NO: 618 - RNA, 19 nt, artificial
  Chemically synthesized
auccacuggugaaacaaau

SEQ ID NO: 619 - RNA, 19 nt, artificial
  Chemically synthesized
agucuuugucuaguuggga

SEQ ID NO: 620 - RNA, 19 nt, artificial
  Chemically synthesized
agcaacaacaaucucaauu

SEQ ID NO: 621 - RNA, 19 nt, artificial
  Chemically synthesized
ugccgcaacucaaagaacu

SEQ ID NO: 622 - RNA, 19 nt, artificial
  Chemically synthesized
agaguuauagauccaggua

SEQ ID NO: 623 - RNA, 19 nt, artificial
  Chemically synthesized
caaguggaucauugacaau

SEQ ID NO: 624 - RNA, 19 nt, artificial
  Chemically synthesized
ucuugugaccgcaauggua

SEQ ID NO: 625 - RNA, 19 nt, artificial
  Chemically synthesized
cugagagcugcgauaaagu

SEQ ID NO: 626 - RNA, 19 nt, artificial
  Chemically synthesized
cccuucaaguugugucuuc

SEQ ID NO: 627 - RNA, 19 nt, artificial
  Chemically synthesized
ggccaacuguaaucuguag

SEQ ID NO: 628 - RNA, 19 nt, artificial
  Chemically synthesized
gacauccaauggaauuaac

SEQ ID NO: 629 - RNA, 19 nt, artificial
  Chemically synthesized
gcaacuugacucauuucac

SEQ ID NO: 630 - RNA, 19 nt, artificial
  Chemically synthesized
aguuaaguucauucagaca

SEQ ID NO: 631 - RNA, 19 nt, artificial
  Chemically synthesized
gaaaaucaccgaugaaagu

SEQ ID NO: 632 - RNA, 19 nt, artificial
  Chemically synthesized
cucuguccuaccuagcugu

SEQ ID NO: 633 - RNA, 19 nt, artificial
  Chemically synthesized
cacuggacaaugccacaua

SEQ ID NO: 634 - RNA, 19 nt, artificial
  Chemically synthesized
auccugagagugggaaaua

SEQ ID NO: 635 - RNA, 19 nt, artificial
  Chemically synthesized
agcccauugagaaaaaagc

SEQ ID NO: 636 - RNA, 19 nt, artificial
  Chemically synthesized
agucuugaacauuuagacu

SEQ ID NO: 637 - RNA, 19 nt, artificial
  Chemically synthesized
uguggauggugugggucuu

SEQ ID NO: 638 - RNA, 19 nt, artificial
  Chemically synthesized
uauccacuggugaaacaaa

SEQ ID NO: 639 - RNA, 19 nt, artificial
  Chemically synthesized
acuugacucauuucacaca

SEQ ID NO: 640 - RNA, 19 nt, artificial
  Chemically synthesized
gaacaucugcuaugaugca

SEQ ID NO: 641 - RNA, 19 nt, artificial
  Chemically synthesized
agaggaagauucuuuuucu

SEQ ID NO: 642 - RNA, 19 nt, artificial
  Chemically synthesized
cuagguucccauauuuaag

SEQ ID NO: 643 - RNA, 19 nt, artificial
  Chemically synthesized
aaaucaccgaugaaaguuu

SEQ ID NO: 644 - RNA, 19 nt, artificial
  Chemically synthesized
gaggaagauucuuuuucuu

SEQ ID NO: 645 - RNA, 19 nt, artificial
  Chemically synthesized
ccacaaaacugucuuugug

SEQ ID NO: 646 - RNA, 19 nt, artificial
  Chemically synthesized
cuuaagauucucaaugacu

SEQ ID NO: 647 - RNA, 19 nt, artificial
  Chemically synthesized
cuccucuguggccacaaaa

SEQ ID NO: 648 - RNA, 19 nt, artificial
  Chemically synthesized
auuccuggcaaguggauca

SEQ ID NO: 649 - RNA, 19 nt, artificial
  Chemically synthesized
gugcucuguuccugcugau

SEQ ID NO: 650 - RNA, 19 nt, artificial
  Chemically synthesized
cuguccaacaacaggauca

SEQ ID NO: 651 - RNA, 19 nt, artificial
  Chemically synthesized
ccacaaaaggcauucucug

SEQ ID NO: 652 - RNA, 19 nt, artificial
  Chemically synthesized
ggacuucucccauuuccgu

SEQ ID NO: 653 - RNA, 19 nt, artificial
  Chemically synthesized
acugcucggaguucuccca

SEQ ID NO: 654 - RNA, 19 nt, artificial
  Chemically synthesized
agauuucuggauuguuaga

SEQ ID NO: 655 - RNA, 19 nt, artificial
  Chemically synthesized
gguccaggagcuggagaac

SEQ ID NO: 656 - RNA, 19 nt, artificial
  Chemically synthesized
cauugugcccauugcucuu

SEQ ID NO: 657 - RNA, 19 nt, artificial
  Chemically synthesized
caaaaucauuuggcaucau

SEQ ID NO: 658 - RNA, 19 nt, artificial
  Chemically synthesized
uaugagauaaccaugauca

SEQ ID NO: 659 - RNA, 19 nt, artificial
  Chemically synthesized
gagcucuuagugaccaagu

SEQ ID NO: 660 - RNA, 19 nt, artificial
  Chemically synthesized
gcugucacuucucugugca

SEQ ID NO: 661 - RNA, 19 nt, artificial
  Chemically synthesized
ggaauugguugcaggaucc

SEQ ID NO: 662 - RNA, 19 nt, artificial
  Chemically synthesized
ggacuuaccuuccuugagg

SEQ ID NO: 663 - RNA, 19 nt, artificial
  Chemically synthesized
accagaugccucccucuua

SEQ ID NO: 664 - RNA, 19 nt, artificial
  Chemically synthesized
aguugguugacuucaugga

SEQ ID NO: 665 - RNA, 19 nt, artificial
  Chemically synthesized
uuagcaacaacaaucucaa

SEQ ID NO: 666 - RNA, 19 nt, artificial
  Chemically synthesized
agugaaaauuugaugguug

SEQ ID NO: 667 - RNA, 19 nt, artificial
  Chemically synthesized
cuggacuuaccuuccuuga

SEQ ID NO: 668 - RNA, 19 nt, artificial
  Chemically synthesized
ugaaaaauucagccuguga

SEQ ID NO: 669 - RNA, 19 nt, artificial
  Chemically synthesized
guggccagaaaagaugaaa

SEQ ID NO: 670 - RNA, 19 nt, artificial
  Chemically synthesized
cccucagggcucacagaag

SEQ ID NO: 671 - RNA, 19 nt, artificial
  Chemically synthesized
gaggcugcauauuccaagg

SEQ ID NO: 672 - RNA, 19 nt, artificial
  Chemically synthesized
ccgccucucggugucggaa

SEQ ID NO: 673 - RNA, 19 nt, artificial
  Chemically synthesized
gguauccaagggaauuggu

SEQ ID NO: 674 - RNA, 19 nt, artificial
  Chemically synthesized
gccagauuuaaaaauuggu

SEQ ID NO: 675 - RNA, 19 nt, artificial
  Chemically synthesized
cagaacuauccacugguga

SEQ ID NO: 676 - RNA, 19 nt, artificial
  Chemically synthesized
gucacuaguuauaguuaag

SEQ ID NO: 677 - RNA, 19 nt, artificial
  Chemically synthesized
uuagcaacagugaccuaca

SEQ ID NO: 678 - RNA, 19 nt, artificial
  Chemically synthesized
uacccuuaauggaguuggu

SEQ ID NO: 679 - RNA, 19 nt, artificial
  Chemically synthesized
uggauguaccgucauuuga

SEQ ID NO: 680 - RNA, 19 nt, artificial
  Chemically synthesized
cuuuccauuuuucagaacu

SEQ ID NO: 681 - RNA, 19 nt, artificial
  Chemically synthesized
agcaggauccaaaggagac

SEQ ID NO: 682 - RNA, 19 nt, artificial
  Chemically synthesized
ccucccucuuacccauguu

SEQ ID NO: 683 - RNA, 19 nt, artificial
  Chemically synthesized
cugaaaacuuugugaagag

SEQ ID NO: 684 - RNA, 19 nt, artificial
  Chemically synthesized
gcauucccaagacacugga

SEQ ID NO: 685 - RNA, 19 nt, artificial
  Chemically synthesized
ucaucucacaaaauugcaa

SEQ ID NO: 686 - RNA, 19 nt, artificial
  Chemically synthesized
agucuauuacugauaucug

SEQ ID NO: 687 - RNA, 19 nt, artificial
  Chemically synthesized
ucugaaaacuuugugaaga

SEQ ID NO: 688 - RNA, 19 nt, artificial
  Chemically synthesized
ggaacaucugcuaugaugc

SEQ ID NO: 689 - RNA, 19 nt, artificial
  Chemically synthesized
gauuucuggauuguuagaa

SEQ ID NO: 690 - RNA, 19 nt, artificial
  Chemically synthesized
agaguuugaugacuguacc

SEQ ID NO: 691 - RNA, 19 nt, artificial
  Chemically synthesized
ucuuuuuucucaucucaca

SEQ ID NO: 692 - RNA, 19 nt, artificial
  Chemically synthesized
ugaguggugcaaguaugaa

SEQ ID NO: 693 - RNA, 19 nt, artificial
  Chemically synthesized
acucugaaaaacuugacua

SEQ ID NO: 694 - RNA, 19 nt, artificial
  Chemically synthesized
cuuuguggauggugugggu

SEQ ID NO: 695 - RNA, 19 nt, artificial
  Chemically synthesized
cucccaguguuugguguug

SEQ ID NO: 696 - RNA, 19 nt, artificial
  Chemically synthesized
acuccucuguggccacaaa

SEQ ID NO: 697 - RNA, 19 nt, artificial
  Chemically synthesized
acugcuggagauuuuugua

SEQ ID NO: 698 - RNA, 19 nt, artificial
  Chemically synthesized
acuuacugggaaauccuua

SEQ ID NO: 699 - RNA, 19 nt, artificial
  Chemically synthesized
ugcuggacuuaccuuccuu

SEQ ID NO: 700 - RNA, 19 nt, artificial
  Chemically synthesized
aauguuuggaacugcgaga

SEQ ID NO: 701 - RNA, 19 nt, artificial
  Chemically synthesized
acccuuaauggaguuggua

SEQ ID NO: 702 - RNA, 19 nt, artificial
  Chemically synthesized
cugcuuucaacugguaguu

SEQ ID NO: 703 - RNA, 19 nt, artificial
  Chemically synthesized
accagucuuugucuaguug

SEQ ID NO: 704 - RNA, 19 nt, artificial
  Chemically synthesized
gggaucuuuaugucacuag

SEQ ID NO: 705 - RNA, 19 nt, artificial
  Chemically synthesized
aaaagauuuugcuggacuu

SEQ ID NO: 706 - RNA, 19 nt, artificial
  Chemically synthesized
gcucauugugcccauugcu

SEQ ID NO: 707 - RNA, 19 nt, artificial
  Chemically synthesized
ucaucagccucuccaagga

SEQ ID NO: 708 - RNA, 19 nt, artificial
  Chemically synthesized
aguuuuucugguuccuugu

SEQ ID NO: 709 - RNA, 19 nt, artificial
  Chemically synthesized
cucaucucacaaaauugca

SEQ ID NO: 710 - RNA, 19 nt, artificial
  Chemically synthesized
cauuuuucagaacuaucca

SEQ ID NO: 711 - RNA, 19 nt, artificial
  Chemically synthesized
gagcaacuugacucauuuc

SEQ ID NO: 712 - RNA, 19 nt, artificial
  Chemically synthesized
ggagaccuauagugacucc

SEQ ID NO: 713 - RNA, 19 nt, artificial
  Chemically synthesized
ucccauauuuaagaccagu

SEQ ID NO: 714 - RNA, 19 nt, artificial
  Chemically synthesized
ggaugccuggcccucucua

SEQ ID NO: 715 - RNA, 19 nt, artificial
  Chemically synthesized
gcagaacccauggauauag

SEQ ID NO: 716 - RNA, 19 nt, artificial
  Chemically synthesized
cucugugcagcugaucuca

SEQ ID NO: 717 - RNA, 19 nt, artificial
  Chemically synthesized
auaucauugacuccauuga

SEQ ID NO: 718 - RNA, 19 nt, artificial
  Chemically synthesized
uuucauucuaugccugaaa

SEQ ID NO: 719 - RNA, 19 nt, artificial
  Chemically synthesized
auucccaagacacuggaaa

SEQ ID NO: 720 - RNA, 19 nt, artificial
  Chemically synthesized
auccaaaggagaccuauag

SEQ ID NO: 721 - RNA, 19 nt, artificial
  Chemically synthesized
agcaacuggcuuaguucau

SEQ ID NO: 722 - RNA, 19 nt, artificial
  Chemically synthesized
cuacuggguggagaaccuu

SEQ ID NO: 723 - RNA, 19 nt, artificial
  Chemically synthesized
cuuuggaagcugguggcaa

SEQ ID NO: 724 - RNA, 19 nt, artificial
  Chemically synthesized
uucauaugaagcagcauau

SEQ ID NO: 725 - RNA, 19 nt, artificial
  Chemically synthesized
caaugaugcugccauucuc

SEQ ID NO: 726 - RNA, 19 nt, artificial
  Chemically synthesized
guagcaacuggcuuaguuc

SEQ ID NO: 727 - RNA, 19 nt, artificial
  Chemically synthesized
cuauccacuggugaaacaa

SEQ ID NO: 728 - RNA, 19 nt, artificial
  Chemically synthesized
cagugaccuacagaggugu

SEQ ID NO: 729 - RNA, 19 nt, artificial
  Chemically synthesized
gcaauaacuucauuugcuc

SEQ ID NO: 730 - RNA, 19 nt, artificial
  Chemically synthesized
uggcaucauuggaaaaaac

SEQ ID NO: 731 - RNA, 19 nt, artificial
  Chemically synthesized
aaaccuuggaauaugcagc

SEQ ID NO: 732 - RNA, 19 nt, artificial
  Chemically synthesized
uugguguucauuaucuucc

SEQ ID NO: 733 - RNA, 19 nt, artificial
  Chemically synthesized
uuaaaguuuguagagaggg

SEQ ID NO: 734 - RNA, 19 nt, artificial
  Chemically synthesized
uuuuuucucaaugggcucc

SEQ ID NO: 735 - RNA, 19 nt, artificial
  Chemically synthesized
aaacacugggagaacuccg

SEQ ID NO: 736 - RNA, 19 nt, artificial
  Chemically synthesized
uuaccaacuccauuaaggg

SEQ ID NO: 737 - RNA, 19 nt, artificial
  Chemically synthesized
uuaugaucaugguuaucuc

SEQ ID NO: 738 - RNA, 19 nt, artificial
  Chemically synthesized
uugccaggaaugaaguccc

SEQ ID NO: 739 - RNA, 19 nt, artificial
  Chemically synthesized
ucagauaucaguaauagac

SEQ ID NO: 740 - RNA, 19 nt, artificial
  Chemically synthesized
uugacuucaaacuuuuugg

SEQ ID NO: 741 - RNA, 19 nt, artificial
  Chemically synthesized
aaaugagucaaguugcucc

SEQ ID NO: 742 - RNA, 19 nt, artificial
  Chemically synthesized
uuuucauauaccacaggcc

SEQ ID NO: 743 - RNA, 19 nt, artificial
  Chemically synthesized
aaauccuucccgcugagcc

SEQ ID NO: 744 - RNA, 19 nt, artificial
  Chemically synthesized
aacaucuacaaaaaucucc

SEQ ID NO: 745 - RNA, 19 nt, artificial
  Chemically synthesized
ugaaaguaaacaaggaacc

SEQ ID NO: 746 - RNA, 19 nt, artificial
  Chemically synthesized
aaauacuuugccuuguugc

SEQ ID NO: 747 - RNA, 19 nt, artificial
  Chemically synthesized
ucucuuagcaggaagaaag

SEQ ID NO: 748 - RNA, 19 nt, artificial
  Chemically synthesized
aacuagacaaagacugguc

SEQ ID NO: 749 - RNA, 19 nt, artificial
  Chemically synthesized
uuuccuaaugaacuaagcc

SEQ ID NO: 750 - RNA, 19 nt, artificial
  Chemically synthesized
uaaaguuuguagagagggc

SEQ ID NO: 751 - RNA, 19 nt, artificial
  Chemically synthesized
aauagacuuaugaucaugg

SEQ ID NO: 752 - RNA, 19 nt, artificial
  Chemically synthesized
uguugugaaaguaaacaag

SEQ ID NO: 753 - RNA, 19 nt, artificial
  Chemically synthesized
uuguccagugcuucaaccc

SEQ ID NO: 754 - RNA, 19 nt, artificial
  Chemically synthesized
auaaagaucccaacuagac

SEQ ID NO: 755 - RNA, 19 nt, artificial
  Chemically synthesized
acuagugacauaaagaucc

SEQ ID NO: 756 - RNA, 19 nt, artificial
  Chemically synthesized
agucucuccgguuuuuucc

SEQ ID NO: 757 - RNA, 19 nt, artificial
  Chemically synthesized
uuaauaggaaauacacagc

SEQ ID NO: 758 - RNA, 19 nt, artificial
  Chemically synthesized
caaauuuucacugagaucc

SEQ ID NO: 759 - RNA, 19 nt, artificial
  Chemically synthesized
uuagcaggaagaaagaaug

SEQ ID NO: 760 - RNA, 19 nt, artificial
  Chemically synthesized
auaggucuccuuuggaucc

SEQ ID NO: 761 - RNA, 19 nt, artificial
  Chemically synthesized
uuuuguaaggauuucccag

SEQ ID NO: 762 - RNA, 19 nt, artificial
  Chemically synthesized
uuguucucaucaaaaagac

SEQ ID NO: 763 - RNA, 19 nt, artificial
  Chemically synthesized
ucaaugaauuuguuucacc

SEQ ID NO: 764 - RNA, 19 nt, artificial
  Chemically synthesized
ucagaaagcacaaagacag

SEQ ID NO: 765 - RNA, 19 nt, artificial
  Chemically synthesized
uucaccaguggauaguucu

SEQ ID NO: 766 - RNA, 19 nt, artificial
  Chemically synthesized
uucugaauugacuucaaac

SEQ ID NO: 767 - RNA, 19 nt, artificial
  Chemically synthesized
uuuuucucaaugggcucca

SEQ ID NO: 768 - RNA, 19 nt, artificial
  Chemically synthesized
aauagcaacaaguuuuggg

SEQ ID NO: 769 - RNA, 19 nt, artificial
  Chemically synthesized
uaaagaucccaacuagaca

SEQ ID NO: 770 - RNA, 19 nt, artificial
  Chemically synthesized
uccaguucauacuugcacc

SEQ ID NO: 771 - RNA, 19 nt, artificial
  Chemically synthesized
uuuuucuaggaauagcaac

SEQ ID NO: 772 - RNA, 19 nt, artificial
  Chemically synthesized
uuacccaaaauccuucccg

SEQ ID NO: 773 - RNA, 19 nt, artificial
  Chemically synthesized
aaccuuggaauaugcagcc

SEQ ID NO: 774 - RNA, 19 nt, artificial
  Chemically synthesized
uuagucaaguuuuucagag

SEQ ID NO: 775 - RNA, 19 nt, artificial
  Chemically synthesized
ucagagugagcaaagucuc

SEQ ID NO: 776 - RNA, 19 nt, artificial
  Chemically synthesized
uucacuuggucacuaagag

SEQ ID NO: 777 - RNA, 19 nt, artificial
  Chemically synthesized
uggaccauaagguucucca

SEQ ID NO: 778 - RNA, 19 nt, artificial
  Chemically synthesized
augauauugucaaugaucc

SEQ ID NO: 779 - RNA, 19 nt, artificial
  Chemically synthesized
uugcuaauguaggugaucc

SEQ ID NO: 780 - RNA, 19 nt, artificial
  Chemically synthesized
auugaaguucuccagcucc

SEQ ID NO: 781 - RNA, 19 nt, artificial
  Chemically synthesized
uuuacagcuucugugagcc

SEQ ID NO: 782 - RNA, 19 nt, artificial
  Chemically synthesized
auauugucaaugauccacu

SEQ ID NO: 783 - RNA, 19 nt, artificial
  Chemically synthesized
aaucaaucaagacuuuggc

SEQ ID NO: 784 - RNA, 19 nt, artificial
  Chemically synthesized
aauggcagcaucauuguuc

SEQ ID NO: 785 - RNA, 19 nt, artificial
  Chemically synthesized
uucagagugagcaaagucu

SEQ ID NO: 786 - RNA, 19 nt, artificial
  Chemically synthesized
aucccaacuagacaaagac

SEQ ID NO: 787 - RNA, 19 nt, artificial
  Chemically synthesized
ucuaauucuaacaauccag

SEQ ID NO: 788 - RNA, 19 nt, artificial
  Chemically synthesized
acugauaucaauguuaguc

SEQ ID NO: 789 - RNA, 19 nt, artificial
  Chemically synthesized
uuuggauccugcuugcaac

SEQ ID NO: 790 - RNA, 19 nt, artificial
  Chemically synthesized
accauaagguucuccaccc

SEQ ID NO: 791 - RNA, 19 nt, artificial
  Chemically synthesized
aucugguagagucaucaac

SEQ ID NO: 792 - RNA, 19 nt, artificial
  Chemically synthesized
augaagucaaccaacugug

SEQ ID NO: 793 - RNA, 19 nt, artificial
  Chemically synthesized
uuggaugucagcaccagag

SEQ ID NO: 794 - RNA, 19 nt, artificial
  Chemically synthesized
uaaaguucuuugaguugcg

SEQ ID NO: 795 - RNA, 19 nt, artificial
  Chemically synthesized
aguuuuaguaagcaagucc

SEQ ID NO: 796 - RNA, 19 nt, artificial
  Chemically synthesized
uauccauggguucugcauc

SEQ ID NO: 797 - RNA, 19 nt, artificial
  Chemically synthesized
auuuucacugagauccaag

SEQ ID NO: 798 - RNA, 19 nt, artificial
  Chemically synthesized
uuuucuaggaauagcaaca

SEQ ID NO: 799 - RNA, 19 nt, artificial
  Chemically synthesized
aaaguauguggcauugucc

SEQ ID NO: 800 - RNA, 19 nt, artificial
  Chemically synthesized
aucaguaucucgcaguucc

SEQ ID NO: 801 - RNA, 19 nt, artificial
  Chemically synthesized
ugcaacaccaaacacuggg

SEQ ID NO: 802 - RNA, 19 nt, artificial
  Chemically synthesized
uaaugaacuaagccaguug

SEQ ID NO: 803 - RNA, 19 nt, artificial
  Chemically synthesized
aaauaugggaaccuaggac

SEQ ID NO: 804 - RNA, 19 nt, artificial
  Chemically synthesized
uuaccuggaucuauaacuc

SEQ ID NO: 805 - RNA, 19 nt, artificial
  Chemically synthesized
aaguucuuugaguugcggc

SEQ ID NO: 806 - RNA, 19 nt, artificial
  Chemically synthesized
ucugguagagucaucaacu

SEQ ID NO: 807 - RNA, 19 nt, artificial
  Chemically synthesized
aaauguucaagacugccca

SEQ ID NO: 808 - RNA, 19 nt, artificial
  Chemically synthesized
uuacacuguguauucgugu

SEQ ID NO: 809 - RNA, 19 nt, artificial
  Chemically synthesized
aaaguuuucagaaagcaca

SEQ ID NO: 810 - RNA, 19 nt, artificial
  Chemically synthesized
uacuuugccuuguugcucu

SEQ ID NO: 811 - RNA, 19 nt, artificial
  Chemically synthesized
ucacuguugcuaauguagg

SEQ ID NO: 812 - RNA, 19 nt, artificial
  Chemically synthesized
auacacagcacuuuuuucu

SEQ ID NO: 813 - RNA, 19 nt, artificial
  Chemically synthesized
uguccugugacauuccgac

SEQ ID NO: 814 - RNA, 19 nt, artificial
  Chemically synthesized
auuguguuaauuccauugg

SEQ ID NO: 815 - RNA, 19 nt, artificial
  Chemically synthesized
uuccaaagucuucagugug

SEQ ID NO: 816 - RNA, 19 nt, artificial
  Chemically synthesized
uaugcugcuucauaugaag

SEQ ID NO: 817 - RNA, 19 nt, artificial
  Chemically synthesized
agaacuccgagcagucacc

SEQ ID NO: 818 - RNA, 19 nt, artificial
  Chemically synthesized
uuuacuguuuucuacugug

SEQ ID NO: 819 - RNA, 19 nt, artificial
  Chemically synthesized
aaaguaaacaaggaaccag

SEQ ID NO: 820 - RNA, 19 nt, artificial
  Chemically synthesized
uuuucucaaugggcuccag

SEQ ID NO: 821 - RNA, 19 nt, artificial
  Chemically synthesized
ugaagacacaacuugaagg

SEQ ID NO: 822 - RNA, 19 nt, artificial
  Chemically synthesized
aaacuuuuuggcucauagc

SEQ ID NO: 823 - RNA, 19 nt, artificial
  Chemically synthesized
aagaaugacacagucauug

SEQ ID NO: 824 - RNA, 19 nt, artificial
  Chemically synthesized
aauggcuuuuuucucaaug

SEQ ID NO: 825 - RNA, 19 nt, artificial
  Chemically synthesized
aaugcagccuguuacacug

SEQ ID NO: 826 - RNA, 19 nt, artificial
  Chemically synthesized
uuucagaaagcacaaagac

SEQ ID NO: 827 - RNA, 19 nt, artificial
  Chemically synthesized
auaaaguucuuugaguugc

SEQ ID NO: 828 - RNA, 19 nt, artificial
  Chemically synthesized
aagacuggucuuaaauaug

SEQ ID NO: 829 - RNA, 19 nt, artificial
  Chemically synthesized
agcaucaaucucaaguucc

SEQ ID NO: 830 - RNA, 19 nt, artificial
  Chemically synthesized
uguuagucaaguuuuucag

SEQ ID NO: 831 - RNA, 19 nt, artificial
  Chemically synthesized
auuguccagugcuucaacc

SEQ ID NO: 832 - RNA, 19 nt, artificial
  Chemically synthesized
aauguuaaagaagaaaggg

SEQ ID NO: 833 - RNA, 19 nt, artificial
  Chemically synthesized
uucccuuggauaccaaggg

SEQ ID NO: 834 - RNA, 19 nt, artificial
  Chemically synthesized
ugaagcaucaaucucaagu

SEQ ID NO: 835 - RNA, 19 nt, artificial
  Chemically synthesized
uuuguggcucuuuucaaug

SEQ ID NO: 836 - RNA, 19 nt, artificial
  Chemically synthesized
uuuucacugagauccaagu

SEQ ID NO: 837 - RNA, 19 nt, artificial
  Chemically synthesized
uucauaugaaggaucagau

SEQ ID NO: 838 - RNA, 19 nt, artificial
  Chemically synthesized
auacuuugccuuguugcuc

SEQ ID NO: 839 - RNA, 19 nt, artificial
  Chemically synthesized
aaaugaaguuauugccacc

SEQ ID NO: 840 - RNA, 19 nt, artificial
  Chemically synthesized
uguaguuuuaguaagcaag

SEQ ID NO: 841 - RNA, 19 nt, artificial
  Chemically synthesized
aauaugggaaccuaggacu

SEQ ID NO: 842 - RNA, 19 nt, artificial
  Chemically synthesized
cuugccaggaaugaagucc

SEQ ID NO: 843 - RNA, 19 nt, artificial
  Chemically synthesized
uacagauuacaguuggccc

SEQ ID NO: 844 - RNA, 19 nt, artificial
  Chemically synthesized
auauuucaucuuuucuggc

SEQ ID NO: 845 - RNA, 19 nt, artificial
  Chemically synthesized
agagugagcaaagucucuc

SEQ ID NO: 846 - RNA, 19 nt, artificial
  Chemically synthesized
uaauaggaaauacacagca

SEQ ID NO: 847 - RNA, 19 nt, artificial
  Chemically synthesized
ugacuucaaacuuuuuggc

SEQ ID NO: 848 - RNA, 19 nt, artificial
  Chemically synthesized
ucauacuugcaccacucac

SEQ ID NO: 849 - RNA, 19 nt, artificial
  Chemically synthesized
ucagugugugaaaugaguc

SEQ ID NO: 850 - RNA, 19 nt, artificial
  Chemically synthesized
ugucauuaucagaugcucu

SEQ ID NO: 851 - RNA, 19 nt, artificial
  Chemically synthesized
aacaaaugcaucauagcag

SEQ ID NO: 852 - RNA, 19 nt, artificial
  Chemically synthesized
aaacgguggcacaggaccc

SEQ ID NO: 853 - RNA, 19 nt, artificial
  Chemically synthesized
aaguccaguucauacuugc

SEQ ID NO: 854 - RNA, 19 nt, artificial
  Chemically synthesized
uucauuaucuuccgcagcu

SEQ ID NO: 855 - RNA, 19 nt, artificial
  Chemically synthesized
uuaacucuuucuguaagug

SEQ ID NO: 856 - RNA, 19 nt, artificial
  Chemically synthesized
aagucuaaauguucaagac

SEQ ID NO: 857 - RNA, 19 nt, artificial
  Chemically synthesized
auggcuuuuuucucaaugg

SEQ ID NO: 858 - RNA, 19 nt, artificial
  Chemically synthesized
aacucugucauuaucagau

SEQ ID NO: 859 - RNA, 19 nt, artificial
  Chemically synthesized
acuagacaaagacuggucu

SEQ ID NO: 860 - RNA, 19 nt, artificial
  Chemically synthesized
agagccuggagguucacac

SEQ ID NO: 861 - RNA, 19 nt, artificial
  Chemically synthesized
uuccuuuuggccuggagcc

SEQ ID NO: 862 - RNA, 19 nt, artificial
  Chemically synthesized
agugucuugggaaugcagc

SEQ ID NO: 863 - RNA, 19 nt, artificial
  Chemically synthesized
aaggagaggaauucacagg

SEQ ID NO: 864 - RNA, 19 nt, artificial
  Chemically synthesized
aaagacaguuuuguggcuc

SEQ ID NO: 865 - RNA, 19 nt, artificial
  Chemically synthesized
aaucucaaguuccucaagg

SEQ ID NO: 866 - RNA, 19 nt, artificial
  Chemically synthesized
uucugaaaaauggaaagug

SEQ ID NO: 867 - RNA, 19 nt, artificial
  Chemically synthesized
uuggccuggagccaggccc

SEQ ID NO: 868 - RNA, 19 nt, artificial
  Chemically synthesized
uuucagagugagcaaaguc

SEQ ID NO: 869 - RNA, 19 nt, artificial
  Chemically synthesized
acucuaauucuaacaaucc

SEQ ID NO: 870 - RNA, 19 nt, artificial
  Chemically synthesized
agugcuucaacccacaacu

SEQ ID NO: 871 - RNA, 19 nt, artificial
  Chemically synthesized
uaauuccauuggaugucag

SEQ ID NO: 872 - RNA, 19 nt, artificial
  Chemically synthesized
agcaaaugaaguuauugcc

SEQ ID NO: 873 - RNA, 19 nt, artificial
  Chemically synthesized
aaggguacagucaucaaac

SEQ ID NO: 874 - RNA, 19 nt, artificial
  Chemically synthesized
uuuuacagcuucugugagc

SEQ ID NO: 875 - RNA, 19 nt, artificial
  Chemically synthesized
aagucucuccgguuuuuuc

SEQ ID NO: 876 - RNA, 19 nt, artificial
  Chemically synthesized
aacuagugacauaaagauc

SEQ ID NO: 877 - RNA, 19 nt, artificial
  Chemically synthesized
auuuucauauaccacaggc

SEQ ID NO: 878 - RNA, 19 nt, artificial
  Chemically synthesized
ugucaaugauccacuugcc

SEQ ID NO: 879 - RNA, 19 nt, artificial
  Chemically synthesized
uguaagaaacaaaugcauc

SEQ ID NO: 880 - RNA, 19 nt, artificial
  Chemically synthesized
aauacuuugccuuguugcu

SEQ ID NO: 881 - RNA, 19 nt, artificial
  Chemically synthesized
aaaaccuuggaauaugcag

SEQ ID NO: 882 - RNA, 19 nt, artificial
  Chemically synthesized
uguccaaaucaguaucucg

SEQ ID NO: 883 - RNA, 19 nt, artificial
  Chemically synthesized
uauauccauggguucugca

SEQ ID NO: 884 - RNA, 19 nt, artificial
  Chemically synthesized
aauauaaagugcucagauc

SEQ ID NO: 885 - RNA, 19 nt, artificial
  Chemically synthesized
caguaauagacuuaugauc

SEQ ID NO: 886 - RNA, 19 nt, artificial
  Chemically synthesized
uugauauccacgaggaucc

SEQ ID NO: 887 - RNA, 19 nt, artificial
  Chemically synthesized
uuucucaaugggcuccaga

SEQ ID NO: 888 - RNA, 19 nt, artificial
  Chemically synthesized
auaccaagggacuauauuc

SEQ ID NO: 889 - RNA, 19 nt, artificial
  Chemically synthesized
uugccuuguugcucuugag

SEQ ID NO: 890 - RNA, 19 nt, artificial
  Chemically synthesized
uuccgcagcuugcagaagc

SEQ ID NO: 891 - RNA, 19 nt, artificial
  Chemically synthesized
aaccaucaaauuuucacug

SEQ ID NO: 892 - RNA, 19 nt, artificial
  Chemically synthesized
uaaccugaaacaaacuuuc

SEQ ID NO: 893 - RNA, 19 nt, artificial
  Chemically synthesized
auuaaaguuuguagagagg

SEQ ID NO: 894 - RNA, 19 nt, artificial
  Chemically synthesized
uaugaucaugguuaucuca

SEQ ID NO: 895 - RNA, 19 nt, artificial
  Chemically synthesized
auuggaggauucuuccuug

SEQ ID NO: 896 - RNA, 19 nt, artificial
  Chemically synthesized
uugaaagcagugaaagagc

SEQ ID NO: 897 - RNA, 19 nt, artificial
  Chemically synthesized
uccuaaugaacuaagccag

SEQ ID NO: 898 - RNA, 19 nt, artificial
  Chemically synthesized
aaugaacuaagccaguugc

SEQ ID NO: 899 - RNA, 19 nt, artificial
  Chemically synthesized
aacacugggagaacuccga

SEQ ID NO: 900 - RNA, 19 nt, artificial
  Chemically synthesized
uuccugggcuuccuuuugg

SEQ ID NO: 901 - RNA, 19 nt, artificial
  Chemically synthesized
acugggagaacuccgagca

SEQ ID NO: 902 - RNA, 19 nt, artificial
  Chemically synthesized
agagaaugccuuuuguggc

SEQ ID NO: 903 - RNA, 19 nt, artificial
  Chemically synthesized
ucuaaaauuaccaacucca

SEQ ID NO: 904 - RNA, 19 nt, artificial
  Chemically synthesized
ugaaucuuagugaaggugu

SEQ ID NO: 905 - RNA, 19 nt, artificial
  Chemically synthesized
agugagcaaagucucuccg

SEQ ID NO: 906 - RNA, 19 nt, artificial
  Chemically synthesized
augaauuuugauauccacg

SEQ ID NO: 907 - RNA, 19 nt, artificial
  Chemically synthesized
uguuacacuguguauucgu

SEQ ID NO: 908 - RNA, 19 nt, artificial
  Chemically synthesized
ucuaggaauagcaacaagu

SEQ ID NO: 909 - RNA, 19 nt, artificial
  Chemically synthesized
aacuuuuuggcucauagcu

SEQ ID NO: 910 - RNA, 19 nt, artificial
  Chemically synthesized
auacuugcaccacucacuc

SEQ ID NO: 911 - RNA, 19 nt, artificial
  Chemically synthesized
uucauaaccugaaacaaac

SEQ ID NO: 912 - RNA, 19 nt, artificial
  Chemically synthesized
uuacagcuucugugagccc

SEQ ID NO: 913 - RNA, 19 nt, artificial
  Chemically synthesized
aguuauugcauuccuacug

SEQ ID NO: 914 - RNA, 19 nt, artificial
  Chemically synthesized
acuguaagaaacaaaugca

SEQ ID NO: 915 - RNA, 19 nt, artificial
  Chemically synthesized
uuugaaucuuagugaaggu

SEQ ID NO: 916 - RNA, 19 nt, artificial
  Chemically synthesized
agguucuccacccaguagg

SEQ ID NO: 917 - RNA, 19 nt, artificial
  Chemically synthesized
auuaucuuccgcagcuugc

SEQ ID NO: 918 - RNA, 19 nt, artificial
  Chemically synthesized
ugaugccaaaugauuuugc

SEQ ID NO: 919 - RNA, 19 nt, artificial
  Chemically synthesized
uuuccugggcuuccuuuug

SEQ ID NO: 920 - RNA, 19 nt, artificial
  Chemically synthesized
uuggaggauucuuccuugg

SEQ ID NO: 921 - RNA, 19 nt, artificial
  Chemically synthesized
uuucaucggugauuuucac

SEQ ID NO: 922 - RNA, 19 nt, artificial
  Chemically synthesized
aauuccauuggaugucagc

SEQ ID NO: 923 - RNA, 19 nt, artificial
  Chemically synthesized
uucccgcugagccucgucc

SEQ ID NO: 924 - RNA, 19 nt, artificial
  Chemically synthesized
uguucucaucaaaaagacg

SEQ ID NO: 925 - RNA, 19 nt, artificial
  Chemically synthesized
uuaucuuccgcagcuugca

SEQ ID NO: 926 - RNA, 19 nt, artificial
  Chemically synthesized
ucaaugauccacuugccag

SEQ ID NO: 927 - RNA, 19 nt, artificial
  Chemically synthesized
ucauagcagauguuccugc

SEQ ID NO: 928 - RNA, 19 nt, artificial
  Chemically synthesized
uucaaguauucuucaacca

SEQ ID NO: 929 - RNA, 19 nt, artificial
  Chemically synthesized
uuugcaauuuugugagaug

SEQ ID NO: 930 - RNA, 19 nt, artificial
  Chemically synthesized
ucugaauugacuucaaacu

SEQ ID NO: 931 - RNA, 19 nt, artificial
  Chemically synthesized
aaaugcaucauagcagaug

SEQ ID NO: 932 - RNA, 19 nt, artificial
  Chemically synthesized
uucuuccuuggagaggcug

SEQ ID NO: 933 - RNA, 19 nt, artificial
  Chemically synthesized
uuagugaagguguccauau

SEQ ID NO: 934 - RNA, 19 nt, artificial
  Chemically synthesized
uuuacccaaaauccuuccc

SEQ ID NO: 935 - RNA, 19 nt, artificial
  Chemically synthesized
uuucuggccacugacaagu

SEQ ID NO: 936 - RNA, 19 nt, artificial
  Chemically synthesized
ugucuugggaaugcagccu

SEQ ID NO: 937 - RNA, 19 nt, artificial
  Chemically synthesized
guucucaucaaaaagacgg

SEQ ID NO: 938 - RNA, 19 nt, artificial
  Chemically synthesized
uuuuuggcucauagcucug

SEQ ID NO: 939 - RNA, 19 nt, artificial
  Chemically synthesized
uggucuuaaauaugggaac

SEQ ID NO: 940 - RNA, 19 nt, artificial
  Chemically synthesized
ugaaguuauugccaccagc

SEQ ID NO: 941 - RNA, 19 nt, artificial
  Chemically synthesized
uucagaaagcacaaagaca

SEQ ID NO: 942 - RNA, 19 nt, artificial
  Chemically synthesized
acaacuaccaguugaaagc

SEQ ID NO: 943 - RNA, 19 nt, artificial
  Chemically synthesized
uacccaaaauccuucccgc

SEQ ID NO: 944 - RNA, 19 nt, artificial
  Chemically synthesized
uaagccaguugcuacagau

SEQ ID NO: 945 - RNA, 19 nt, artificial
  Chemically synthesized
aaauaugcugcuucauaug

SEQ ID NO: 946 - RNA, 19 nt, artificial
  Chemically synthesized
acuucaaacuuuuuggcuc

SEQ ID NO: 947 - RNA, 19 nt, artificial
  Chemically synthesized
uguucauuaucuuccgcag

SEQ ID NO: 948 - RNA, 19 nt, artificial
  Chemically synthesized
agacuggucuuaaauaugg

SEQ ID NO: 949 - RNA, 19 nt, artificial
  Chemically synthesized
ucaaauuuucacugagauc

SEQ ID NO: 950 - RNA, 19 nt, artificial
  Chemically synthesized
acaggcugaauuuuucaag

SEQ ID NO: 951 - RNA, 19 nt, artificial
  Chemically synthesized
uaaaauuuccagugucuug

SEQ ID NO: 952 - RNA, 19 nt, artificial
  Chemically synthesized
gauucuuccuuggagaggc

SEQ ID NO: 953 - RNA, 19 nt, artificial
  Chemically synthesized
uguuuauaaaacagcaccc

SEQ ID NO: 954 - RNA, 19 nt, artificial
  Chemically synthesized
uagacaaagacuggucuua

SEQ ID NO: 955 - RNA, 19 nt, artificial
  Chemically synthesized
ugagccucguccaugggcc

SEQ ID NO: 956 - RNA, 19 nt, artificial
  Chemically synthesized
aucuacaaaaaucuccagc

SEQ ID NO: 957 - RNA, 19 nt, artificial
  Chemically synthesized
auaggaaauacacagcacu

SEQ ID NO: 958 - RNA, 19 nt, artificial
  Chemically synthesized
gagaggcugaugaugaccc

SEQ ID NO: 959 - RNA, 19 nt, artificial
  Chemically synthesized
uuccuaaugaacuaagcca

SEQ ID NO: 960 - RNA, 19 nt, artificial
  Chemically synthesized
auuaaggguacagucauca

SEQ ID NO: 961 - RNA, 19 nt, artificial
  Chemically synthesized
auuugcuggccaaucaauc

SEQ ID NO: 962 - RNA, 19 nt, artificial
  Chemically synthesized
auucccuuggauaccaagg

SEQ ID NO: 963 - RNA, 19 nt, artificial
  Chemically synthesized
cuguuuucuacugugauuc

SEQ ID NO: 964 - RNA, 19 nt, artificial
  Chemically synthesized
guugugaaaguaaacaagg

SEQ ID NO: 965 - RNA, 19 nt, artificial
  Chemically synthesized
cacuguaagaaacaaaugc

SEQ ID NO: 966 - RNA, 19 nt, artificial
  Chemically synthesized
ucacuguaagaaacaaaug

SEQ ID NO: 967 - RNA, 19 nt, artificial
  Chemically synthesized
aaagaucccaacuagacaa

SEQ ID NO: 968 - RNA, 19 nt, artificial
  Chemically synthesized
uaggucuccuuuggauccu

SEQ ID NO: 969 - RNA, 19 nt, artificial
  Chemically synthesized
ugacgguacauccacguag

SEQ ID NO: 970 - RNA, 19 nt, artificial
  Chemically synthesized
uuuuucagagugagcaaag

SEQ ID NO: 971 - RNA, 19 nt, artificial
  Chemically synthesized
aaacguaguuauugcauuc

SEQ ID NO: 972 - RNA, 19 nt, artificial
  Chemically synthesized
uggcuuuuuucucaauggg

SEQ ID NO: 973 - RNA, 19 nt, artificial
  Chemically synthesized
ugacuuacauucugaauug

SEQ ID NO: 974 - RNA, 19 nt, artificial
  Chemically synthesized
uuuucagaaagcacaaaga

SEQ ID NO: 975 - RNA, 19 nt, artificial
  Chemically synthesized
agacagagaagccugauug

SEQ ID NO: 976 - RNA, 19 nt, artificial
  Chemically synthesized
acugugauucuuuuaacuc

SEQ ID NO: 977 - RNA, 19 nt, artificial
  Chemically synthesized
acaaagacaguuuuguggc

SEQ ID NO: 978 - RNA, 19 nt, artificial
  Chemically synthesized
uccucuauuguguuaauuc

SEQ ID NO: 979 - RNA, 19 nt, artificial
  Chemically synthesized
uucuccagcuccuggacca

SEQ ID NO: 980 - RNA, 19 nt, artificial
  Chemically synthesized
ugaaggagaggaauucaca

SEQ ID NO: 981 - RNA, 19 nt, artificial
  Chemically synthesized
uccauuggaugucagcacc

SEQ ID NO: 982 - RNA, 19 nt, artificial
  Chemically synthesized
aacuccauuaaggguacag

SEQ ID NO: 983 - RNA, 19 nt, artificial
  Chemically synthesized
ucuguagaucugaagcauc

SEQ ID NO: 984 - RNA, 19 nt, artificial
  Chemically synthesized
uucagugugugaaaugagu

SEQ ID NO: 985 - RNA, 19 nt, artificial
  Chemically synthesized
uuggcucauagcucuguag

SEQ ID NO: 986 - RNA, 19 nt, artificial
  Chemically synthesized
uacacuguguauucgugug

SEQ ID NO: 987 - RNA, 19 nt, artificial
  Chemically synthesized
uucugcauccaugaaguca

SEQ ID NO: 988 - RNA, 19 nt, artificial
  Chemically synthesized
uuucccaguaaguuuaaga

SEQ ID NO: 989 - RNA, 19 nt, artificial
  Chemically synthesized
uaagguucuccacccagua

SEQ ID NO: 990 - RNA, 19 nt, artificial
  Chemically synthesized
uuaauuccauuggauguca

SEQ ID NO: 991 - RNA, 19 nt, artificial
  Chemically synthesized
caaacacugggagaacucc

SEQ ID NO: 992 - RNA, 19 nt, artificial
  Chemically synthesized
auauccacgaggauccugc

SEQ ID NO: 993 - RNA, 19 nt, artificial
  Chemically synthesized
uuuuguggcucuuuucaau

SEQ ID NO: 994 - RNA, 19 nt, artificial
  Chemically synthesized
aauacuaguaacaugggua

SEQ ID NO: 995 - RNA, 19 nt, artificial
  Chemically synthesized
cuuuuuucuaggaauagca

SEQ ID NO: 996 - RNA, 19 nt, artificial
  Chemically synthesized
auccauggguucugcaucc

SEQ ID NO: 997 - RNA, 19 nt, artificial
  Chemically synthesized
aucuuaaguucauuugugc

SEQ ID NO: 998 - RNA, 19 nt, artificial
  Chemically synthesized
uccugggcuuccuuuuggc

SEQ ID NO: 999 - RNA, 19 nt, artificial
  Chemically synthesized
uucacaggagcaaaugaag

SEQ ID NO: 1000 - RNA, 19 nt, artificial
  Chemically synthesized
auuuacccaaaauccuucc

SEQ ID NO: 1001 - RNA, 19 nt, artificial
  Chemically synthesized
aaacaaacuuucaucggug

SEQ ID NO: 1002 - RNA, 19 nt, artificial
  Chemically synthesized
uucucaaugggcuccagaa

SEQ ID NO: 1003 - RNA, 19 nt, artificial
  Chemically synthesized
ucccacucucaggauuugc

SEQ ID NO: 1004 - RNA, 19 nt, artificial
  Chemically synthesized
uagacuuaugaucaugguu

SEQ ID NO: 1005 - RNA, 19 nt, artificial
  Chemically synthesized
auguucaagacugcccagg

SEQ ID NO: 1006 - RNA, 19 nt, artificial
  Chemically synthesized
ucauuuucauauaccacag

SEQ ID NO: 1007 - RNA, 19 nt, artificial
  Chemically synthesized
ugagcaaagucucuccggu

SEQ ID NO: 1008 - RNA, 19 nt, artificial
  Chemically synthesized
ugcccuugcagauaccauu

SEQ ID NO: 1009 - RNA, 19 nt, artificial
  Chemically synthesized
aaaguucuuugaguugcgg

SEQ ID NO: 1010 - RNA, 19 nt, artificial
  Chemically synthesized
uugaguugcggcaaauuca

SEQ ID NO: 1011 - RNA, 19 nt, artificial
  Chemically synthesized
uugaaguucuccagcuccu

SEQ ID NO: 1012 - RNA, 19 nt, artificial
  Chemically synthesized
uuuuuacagcuucugugag

SEQ ID NO: 1013 - RNA, 19 nt, artificial
  Chemically synthesized
auaagguucuccacccagu

SEQ ID NO: 1014 - RNA, 19 nt, artificial
  Chemically synthesized
acagagaaugccuuuugug

SEQ ID NO: 1015 - RNA, 19 nt, artificial
  Chemically synthesized
uuggagaggcugaugauga

SEQ ID NO: 1016 - RNA, 19 nt, artificial
  Chemically synthesized
ugcuccuuagaaaacguag

SEQ ID NO: 1017 - RNA, 19 nt, artificial
  Chemically synthesized
ucuauauccauggguucug

SEQ ID NO: 1018 - RNA, 19 nt, artificial
  Chemically synthesized
ugcucuaaaauuaccaacu

SEQ ID NO: 1019 - RNA, 19 nt, artificial
  Chemically synthesized
aaguauucuucaaccauca

SEQ ID NO: 1020 - RNA, 19 nt, artificial
  Chemically synthesized
aauuuugauauccacgagg

SEQ ID NO: 1021 - RNA, 19 nt, artificial
  Chemically synthesized
cauacuugcaccacucacu

SEQ ID NO: 1022 - RNA, 19 nt, artificial
  Chemically synthesized
ugaauuuguuucaccagug

SEQ ID NO: 1023 - RNA, 19 nt, artificial
  Chemically synthesized
aaguaaacaaggaaccaga

SEQ ID NO: 1024 - RNA, 19 nt, artificial
  Chemically synthesized
uucuccacccaguaggcau

SEQ ID NO: 1025 - RNA, 19 nt, artificial
  Chemically synthesized
cccaacuagacaaagacug

SEQ ID NO: 1026 - RNA, 19 nt, artificial
  Chemically synthesized
cugauuggaggauucuucc

SEQ ID NO: 1027 - RNA, 19 nt, artificial
  Chemically synthesized
aaaugacgguacauccacg

SEQ ID NO: 1028 - RNA, 19 nt, artificial
  Chemically synthesized
aaagucucuccgguuuuuu

SEQ ID NO: 1029 - RNA, 19 nt, artificial
  Chemically synthesized
uuuuuuccaaugaugccaa

SEQ ID NO: 1030 - RNA, 19 nt, artificial
  Chemically synthesized
aauggagucaaugauauug

SEQ ID NO: 1031 - RNA, 19 nt, artificial
  Chemically synthesized
uaucgcagcucucagauuu

SEQ ID NO: 1032 - RNA, 19 nt, artificial
  Chemically synthesized
ucugucauuaucagaugcu

SEQ ID NO: 1033 - RNA, 19 nt, artificial
  Chemically synthesized
uuggucacuaagagcuccu

SEQ ID NO: 1034 - RNA, 19 nt, artificial
  Chemically synthesized
agguaggacagagaaugcc

SEQ ID NO: 1035 - RNA, 19 nt, artificial
  Chemically synthesized
auaugaaggaucagaugac

SEQ ID NO: 1036 - RNA, 19 nt, artificial
  Chemically synthesized
ugcgcuuucucgcugccuc

SEQ ID NO: 1037 - RNA, 19 nt, artificial
  Chemically synthesized
ugggaaugcagccuguuac

SEQ ID NO: 1038 - RNA, 19 nt, artificial
  Chemically synthesized
uaggucacuguugcuaaug

SEQ ID NO: 1039 - RNA, 19 nt, artificial
  Chemically synthesized
acaccauccacaaaguaug

SEQ ID NO: 1040 - RNA, 19 nt, artificial
  Chemically synthesized
ugguguucauuaucuuccg

SEQ ID NO: 1041 - RNA, 19 nt, artificial
  Chemically synthesized
uugcucuugagaucagcug

SEQ ID NO: 1042 - RNA, 19 nt, artificial
  Chemically synthesized
auguuuauaaaacagcacc

SEQ ID NO: 1043 - RNA, 19 nt, artificial
  Chemically synthesized
auauaaagugcucagauca

SEQ ID NO: 1044 - RNA, 19 nt, artificial
  Chemically synthesized
uuugccuuguugcucuuga

SEQ ID NO: 1045 - RNA, 19 nt, artificial
  Chemically synthesized
aaaaagacggaaaugggag

SEQ ID NO: 1046 - RNA, 19 nt, artificial
  Chemically synthesized
cuuaugaucaugguuaucu

SEQ ID NO: 1047 - RNA, 19 nt, artificial
  Chemically synthesized
uaguuuuaguaagcaaguc

SEQ ID NO: 1048 - RNA, 19 nt, artificial
  Chemically synthesized
gaauggaguuuaaagaucc

SEQ ID NO: 1049 - RNA, 19 nt, artificial
  Chemically synthesized
aaguuuuucagagugagca

SEQ ID NO: 1050 - RNA, 19 nt, artificial
  Chemically synthesized
aucuuuucuggccacugac

SEQ ID NO: 1051 - RNA, 19 nt, artificial
  Chemically synthesized
acaucuacaaaaaucucca

SEQ ID NO: 1052 - RNA, 19 nt, artificial
  Chemically synthesized
gugucuugggaaugcagcc

SEQ ID NO: 1053 - RNA, 19 nt, artificial
  Chemically synthesized
acugagauccaaguauucu

SEQ ID NO: 1054 - RNA, 19 nt, artificial
  Chemically synthesized
ucuaaauguucaagacugc

SEQ ID NO: 1055 - RNA, 19 nt, artificial
  Chemically synthesized
aaauuuucacugagaucca

SEQ ID NO: 1056 - RNA, 19 nt, artificial
  Chemically synthesized
acaaagacuggucuuaaau

SEQ ID NO: 1057 - RNA, 19 nt, artificial
  Chemically synthesized
uuacuguuuucuacuguga

SEQ ID NO: 1058 - RNA, 19 nt, artificial
  Chemically synthesized
gaccauaagguucuccacc

SEQ ID NO: 1059 - RNA, 19 nt, artificial
  Chemically synthesized
acuguugcuaauguaggug

SEQ ID NO: 1060 - RNA, 19 nt, artificial
  Chemically synthesized
uugcagauaccauugcggu

SEQ ID NO: 1061 - RNA, 19 nt, artificial
  Chemically synthesized
cuuacauucugaauugacu

SEQ ID NO: 1062 - RNA, 19 nt, artificial
  Chemically synthesized
ugacauaaagaucccaacu

SEQ ID NO: 1063 - RNA, 19 nt, artificial
  Chemically synthesized
aaugggcuccagaagaaug

SEQ ID NO: 1064 - RNA, 19 nt, artificial
  Chemically synthesized
uucuaggaauagcaacaag

SEQ ID NO: 1065 - RNA, 19 nt, artificial
  Chemically synthesized
uugcggucacaagacagag

SEQ ID NO: 1066 - RNA, 19 nt, artificial
  Chemically synthesized
uuuuaguaagcaaguccuc

SEQ ID NO: 1067 - RNA, 19 nt, artificial
  Chemically synthesized
uguguuaauuccauuggau

SEQ ID NO: 1068 - RNA, 19 nt, artificial
  Chemically synthesized
agaaacaaaugcaucauag

SEQ ID NO: 1069 - RNA, 19 nt, artificial
  Chemically synthesized
ccacugacaaguuucaggc

SEQ ID NO: 1070 - RNA, 19 nt, artificial
  Chemically synthesized
uaucuuccgcagcuugcag

SEQ ID NO: 1071 - RNA, 19 nt, artificial
  Chemically synthesized
gauccugcaaccaauuccc

SEQ ID NO: 1072 - RNA, 19 nt, artificial
  Chemically synthesized
uaacguuuccacuuuaccu

SEQ ID NO: 1073 - RNA, 19 nt, artificial
  Chemically synthesized
aaucaguaucucgcaguuc

SEQ ID NO: 1074 - RNA, 19 nt, artificial
  Chemically synthesized
aggauaagucuaaauguuc

SEQ ID NO: 1075 - RNA, 19 nt, artificial
  Chemically synthesized
uacuguuuucuacugugau

SEQ ID NO: 1076 - RNA, 19 nt, artificial
  Chemically synthesized
uugcaacaccaaacacugg

SEQ ID NO: 1077 - RNA, 19 nt, artificial
  Chemically synthesized
guucauacuugcaccacuc

SEQ ID NO: 1078 - RNA, 19 nt, artificial
  Chemically synthesized
cuugcaacaccaaacacug

SEQ ID NO: 1079 - RNA, 19 nt, artificial
  Chemically synthesized
aauaggaaauacacagcac

SEQ ID NO: 1080 - RNA, 19 nt, artificial
  Chemically synthesized
ucaucuuuucuggccacug

SEQ ID NO: 1081 - RNA, 19 nt, artificial
  Chemically synthesized
aaguuucaggcauagaaug

SEQ ID NO: 1082 - RNA, 19 nt, artificial
  Chemically synthesized
aaagucuucagugugugaa

SEQ ID NO: 1083 - RNA, 19 nt, artificial
  Chemically synthesized
auauuucccacucucagga

SEQ ID NO: 1084 - RNA, 19 nt, artificial
  Chemically synthesized
gaaccuaggacuuuaucgc

SEQ ID NO: 1085 - RNA, 19 nt, artificial
  Chemically synthesized
uucaacccacaacuaccag

SEQ ID NO: 1086 - RNA, 19 nt, artificial
  Chemically synthesized
aaugagucaaguugcuccu

SEQ ID NO: 1087 - RNA, 19 nt, artificial
  Chemically synthesized
caaucaaucaagacuuugg

SEQ ID NO: 1088 - RNA, 19 nt, artificial
  Chemically synthesized
aauuaccaacuccauuaag

SEQ ID NO: 1089 - RNA, 19 nt, artificial
  Chemically synthesized
uuccagugucuugggaaug

SEQ ID NO: 1090 - RNA, 19 nt, artificial
  Chemically synthesized
agauccaaguauucuaaug

SEQ ID NO: 1091 - RNA, 19 nt, artificial
  Chemically synthesized
uugugaaaguaaacaagga

SEQ ID NO: 1092 - RNA, 19 nt, artificial
  Chemically synthesized
ugaagucaaccaacugugg

SEQ ID NO: 1093 - RNA, 19 nt, artificial
  Chemically synthesized
cauuccgacaccgagaggc

SEQ ID NO: 1094 - RNA, 19 nt, artificial
  Chemically synthesized
aaagaaucuuccucuauug

SEQ ID NO: 1095 - RNA, 19 nt, artificial
  Chemically synthesized
uguuggacaggucaaggcu

SEQ ID NO: 1096 - RNA, 19 nt, artificial
  Chemically synthesized
aucaaucucaaguuccuca

SEQ ID NO: 1097 - RNA, 19 nt, artificial
  Chemically synthesized
ugaaguucuccagcuccug

SEQ ID NO: 1098 - RNA, 19 nt, artificial
  Chemically synthesized
ucaaucaagacuuuggcca

SEQ ID NO: 1099 - RNA, 19 nt, artificial
  Chemically synthesized
uccucaaggaagguaaguc

SEQ ID NO: 1100 - RNA, 19 nt, artificial
  Chemically synthesized
gcuucaacccacaacuacc

SEQ ID NO: 1101 - RNA, 19 nt, artificial
  Chemically synthesized
ucuacaaaaaucuccagca

SEQ ID NO: 1102 - RNA, 19 nt, artificial
  Chemically synthesized
aguuauugccaccagcuuc

SEQ ID NO: 1103 - RNA, 19 nt, artificial
  Chemically synthesized
ucaaaaagacggaaauggg

SEQ ID NO: 1104 - RNA, 19 nt, artificial
  Chemically synthesized
auucuuccuuggagaggcu

SEQ ID NO: 1105 - RNA, 19 nt, artificial
  Chemically synthesized
uacagcuucugugagcccu

SEQ ID NO: 1106 - RNA, 19 nt, artificial
  Chemically synthesized
ucacucuucacaaaguuuu

SEQ ID NO: 1107 - RNA, 19 nt, artificial
  Chemically synthesized
aguugcuacagauuacagu

SEQ ID NO: 1108 - RNA, 19 nt, artificial
  Chemically synthesized
aucuccagcaguaaaauau

SEQ ID NO: 1109 - RNA, 19 nt, artificial
  Chemically synthesized
agaagugacagcuagguag

SEQ ID NO: 1110 - RNA, 19 nt, artificial
  Chemically synthesized
uaugaaggaucagaugacu

SEQ ID NO: 1111 - RNA, 19 nt, artificial
  Chemically synthesized
gaucagaugacuuacauuc

SEQ ID NO: 1112 - RNA, 19 nt, artificial
  Chemically synthesized
cagugaaagagcaaugggc

SEQ ID NO: 1113 - RNA, 19 nt, artificial
  Chemically synthesized
uuguguuaauuccauugga

SEQ ID NO: 1114 - RNA, 19 nt, artificial
  Chemically synthesized
ccugauuggaggauucuuc

SEQ ID NO: 1115 - RNA, 19 nt, artificial
  Chemically synthesized
uuugauauccacgaggauc

SEQ ID NO: 1116 - RNA, 19 nt, artificial
  Chemically synthesized
aaguguccaaaucaguauc

SEQ ID NO: 1117 - RNA, 19 nt, artificial
  Chemically synthesized
aucaaaaagacggaaaugg

SEQ ID NO: 1118 - RNA, 19 nt, artificial
  Chemically synthesized
gagugagcaaagucucucc

SEQ ID NO: 1119 - RNA, 19 nt, artificial
  Chemically synthesized
ucuuugaaucuuagugaag

SEQ ID NO: 1120 - RNA, 19 nt, artificial
  Chemically synthesized
ugcauccaugaagucaacc

SEQ ID NO: 1121 - RNA, 19 nt, artificial
  Chemically synthesized
aguugcggcaaauucaaag

SEQ ID NO: 1122 - RNA, 19 nt, artificial
  Chemically synthesized
auagacuuaugaucauggu

SEQ ID NO: 1123 - RNA, 19 nt, artificial
  Chemically synthesized
aauucccuuggauaccaag

SEQ ID NO: 1124 - RNA, 19 nt, artificial
  Chemically synthesized
uguuuccuaaugaacuaag

SEQ ID NO: 1125 - RNA, 19 nt, artificial
  Chemically synthesized
auuccacggaacuuguaac

SEQ ID NO: 1126 - RNA, 19 nt, artificial
  Chemically synthesized
gaugccaaaugauuuugcc

SEQ ID NO: 1127 - RNA, 19 nt, artificial
  Chemically synthesized
auuguuguugcuaacaucu

SEQ ID NO: 1128 - RNA, 19 nt, artificial
  Chemically synthesized
aauacacagcacuuuuuuc

SEQ ID NO: 1129 - RNA, 19 nt, artificial
  Chemically synthesized
augcucuaaaauuaccaac

SEQ ID NO: 1130 - RNA, 19 nt, artificial
  Chemically synthesized
auuccgacaccgagaggcg

SEQ ID NO: 1131 - RNA, 19 nt, artificial
  Chemically synthesized
aagcagugaaagagcaaug

SEQ ID NO: 1132 - RNA, 19 nt, artificial
  Chemically synthesized
gucaucaaacucuaauucu

SEQ ID NO: 1133 - RNA, 19 nt, artificial
  Chemically synthesized
aucaaucaagacuuuggcc

SEQ ID NO: 1134 - RNA, 19 nt, artificial
  Chemically synthesized
ucgcaguuccaaacauucc

SEQ ID NO: 1135 - RNA, 19 nt, artificial
  Chemically synthesized
auaugcagccuccggauug

SEQ ID NO: 1136 - RNA, 19 nt, artificial
  Chemically synthesized
aauccuucccgcugagccu

SEQ ID NO: 1137 - RNA, 19 nt, artificial
  Chemically synthesized
acuuuuuucuaggaauagc

SEQ ID NO: 1138 - RNA, 19 nt, artificial
  Chemically synthesized
cuaaauguucaagacugcc

SEQ ID NO: 1139 - RNA, 19 nt, artificial
  Chemically synthesized
uuaaguucauuugugcugu

SEQ ID NO: 1140 - RNA, 19 nt, artificial
  Chemically synthesized
ucuccgguuuuuuccaaug

SEQ ID NO: 1141 - RNA, 19 nt, artificial
  Chemically synthesized
acacuguguauucgugugc

SEQ ID NO: 1142 - RNA, 19 nt, artificial
  Chemically synthesized
ugggagucacuauaggucu

SEQ ID NO: 1143 - RNA, 19 nt, artificial
  Chemically synthesized
cucaaaugacgguacaucc

SEQ ID NO: 1144 - RNA, 19 nt, artificial
  Chemically synthesized
aagguguccauauuuccca

SEQ ID NO: 1145 - RNA, 19 nt, artificial
  Chemically synthesized
aguucauacuugcaccacu

SEQ ID NO: 1146 - RNA, 19 nt, artificial
  Chemically synthesized
auuccauuggaugucagca

SEQ ID NO: 1147 - RNA, 19 nt, artificial
  Chemically synthesized
acagagcacagcacaugcc

SEQ ID NO: 1148 - RNA, 19 nt, artificial
  Chemically synthesized
uguuuucuacugugauucu

SEQ ID NO: 1149 - RNA, 19 nt, artificial
  Chemically synthesized
ucucaaugggcuccagaag

SEQ ID NO: 1150 - RNA, 19 nt, artificial
  Chemically synthesized
acacugggagaacuccgag

SEQ ID NO: 1151 - RNA, 19 nt, artificial
  Chemically synthesized
uccagguaggucuuggugu

SEQ ID NO: 1152 - RNA, 19 nt, artificial
  Chemically synthesized
uaggacuuuaucgcagcuc

SEQ ID NO: 1153 - RNA, 19 nt, artificial
  Chemically synthesized
ucaaguuccucaaggaagg

SEQ ID NO: 1154 - RNA, 19 nt, artificial
  Chemically synthesized
ucacacaccucuguagguc

SEQ ID NO: 1155 - RNA, 19 nt, artificial
  Chemically synthesized
uuuaucgcagcucucagau

SEQ ID NO: 1156 - RNA, 19 nt, artificial
  Chemically synthesized
uaacucugucauuaucaga

SEQ ID NO: 1157 - RNA, 19 nt, artificial
  Chemically synthesized
uauugcauuccuacugauu

SEQ ID NO: 1158 - RNA, 19 nt, artificial
  Chemically synthesized
cuuuuuucucaaugggcuc

SEQ ID NO: 1159 - RNA, 19 nt, artificial
  Chemically synthesized
uaaagugcucagaucauaa

SEQ ID NO: 1160 - RNA, 19 nt, artificial
  Chemically synthesized
uuuuggcucauagcucugu

SEQ ID NO: 1161 - RNA, 19 nt, artificial
  Chemically synthesized
cauuguucucaucaaaaag

SEQ ID NO: 1162 - RNA, 19 nt, artificial
  Chemically synthesized
cacugggagaacuccgagc

SEQ ID NO: 1163 - RNA, 19 nt, artificial
  Chemically synthesized
gguuuuguaaggauuuccc

SEQ ID NO: 1164 - RNA, 19 nt, artificial
  Chemically synthesized
acauucugaauugacuuca

SEQ ID NO: 1165 - RNA, 19 nt, artificial
  Chemically synthesized
aaugacgguacauccacgu

SEQ ID NO: 1166 - RNA, 19 nt, artificial
  Chemically synthesized
ucaaguugcuccuuagaaa

SEQ ID NO: 1167 - RNA, 19 nt, artificial
  Chemically synthesized
cuuugaaucuuagugaagg

SEQ ID NO: 1168 - RNA, 19 nt, artificial
  Chemically synthesized
ucaacccacaacuaccagu

SEQ ID NO: 1169 - RNA, 19 nt, artificial
  Chemically synthesized
uuucccacucucaggauuu

SEQ ID NO: 1170 - RNA, 19 nt, artificial
  Chemically synthesized
cuggaccauaagguucucc

SEQ ID NO: 1171 - RNA, 19 nt, artificial
  Chemically synthesized
ucacugagauccaaguauu

SEQ ID NO: 1172 - RNA, 19 nt, artificial
  Chemically synthesized
uagguaggacagagaaugc

SEQ ID NO: 1173 - RNA, 19 nt, artificial
  Chemically synthesized
uccagaagaaugagaaugg

SEQ ID NO: 1174 - RNA, 19 nt, artificial
  Chemically synthesized
caauccagaaaucugauuc

SEQ ID NO: 1175 - RNA, 19 nt, artificial
  Chemically synthesized
agcaucauuguucucauca

SEQ ID NO: 1176 - RNA, 19 nt, artificial
  Chemically synthesized
uaccaagggacuauauuca

SEQ ID NO: 1177 - RNA, 19 nt, artificial
  Chemically synthesized
aguugcuccuuagaaaacg

SEQ ID NO: 1178 - RNA, 19 nt, artificial
  Chemically synthesized
auuuccagugucuugggaa

SEQ ID NO: 1179 - RNA, 19 nt, artificial
  Chemically synthesized
uuccacuuuaccuggaucu

SEQ ID NO: 1180 - RNA, 19 nt, artificial
  Chemically synthesized
uaaaaccuuggaauaugca

SEQ ID NO: 1181 - RNA, 19 nt, artificial
  Chemically synthesized
gucuaaauguucaagacug

SEQ ID NO: 1182 - RNA, 19 nt, artificial
  Chemically synthesized
ugaaacaaacuuucaucgg

SEQ ID NO: 1183 - RNA, 19 nt, artificial
  Chemically synthesized
aagaaagaaugacacaguc

SEQ ID NO: 1184 - RNA, 19 nt, artificial
  Chemically synthesized
ugaagucccgcuuaugaag

SEQ ID NO: 1185 - RNA, 19 nt, artificial
  Chemically synthesized
uaaacaaggaaccagaaaa

SEQ ID NO: 1186 - RNA, 19 nt, artificial
  Chemically synthesized
augcugcuucauaugaagg

SEQ ID NO: 1187 - RNA, 19 nt, artificial
  Chemically synthesized
uuuucaauggagucaauga

SEQ ID NO: 1188 - RNA, 19 nt, artificial
  Chemically synthesized
cauauuucccacucucagg

SEQ ID NO: 1189 - RNA, 19 nt, artificial
  Chemically synthesized
uuauugcauuccuacugau

SEQ ID NO: 1190 - RNA, 19 nt, artificial
  Chemically synthesized
augaucaugguuaucucau

SEQ ID NO: 1191 - RNA, 19 nt, artificial
  Chemically synthesized
ucuccagcaguaaaauaug

SEQ ID NO: 1192 - RNA, 19 nt, artificial
  Chemically synthesized
uaaauaugggaaccuagga

SEQ ID NO: 1193 - RNA, 19 nt, artificial
  Chemically synthesized
auaccauugcggucacaag

SEQ ID NO: 1194 - RNA, 19 nt, artificial
  Chemically synthesized
auggagucaaugauauugu

SEQ ID NO: 1195 - RNA, 19 nt, artificial
  Chemically synthesized
aggaucagcaggaacagag

SEQ ID NO: 1196 - RNA, 19 nt, artificial
  Chemically synthesized
augccaaaugauuuugccu

SEQ ID NO: 1197 - RNA, 19 nt, artificial
  Chemically synthesized
uaacaauccagaaaucuga

SEQ ID NO: 1198 - RNA, 19 nt, artificial
  Chemically synthesized
augggauggagagucacac

SEQ ID NO: 1199 - RNA, 19 nt, artificial
  Chemically synthesized
cuagguaggacagagaaug

SEQ ID NO: 1200 - RNA, 19 nt, artificial
  Chemically synthesized
uuuaguaagcaaguccuca

SEQ ID NO: 1201 - RNA, 19 nt, artificial
  Chemically synthesized
gcagcucucagauuuaccc

SEQ ID NO: 1202 - RNA, 19 nt, artificial
  Chemically synthesized
aaacaaaugcaucauagca

SEQ ID NO: 1203 - RNA, 19 nt, artificial
  Chemically synthesized
uccagcaguaaaauaugcu

SEQ ID NO: 1204 - RNA, 19 nt, artificial
  Chemically synthesized
uaguuauugcauuccuacu

SEQ ID NO: 1205 - RNA, 19 nt, artificial
  Chemically synthesized
uucgugugcuggauaaguu

SEQ ID NO: 1206 - RNA, 19 nt, artificial
  Chemically synthesized
guccaaaucaguaucucgc

SEQ ID NO: 1207 - RNA, 19 nt, artificial
  Chemically synthesized
ugccaaaugauuuugccuu

SEQ ID NO: 1208 - RNA, 19 nt, artificial
  Chemically synthesized
aguuccaaacauuccacgg

SEQ ID NO: 1209 - RNA, 19 nt, artificial
  Chemically synthesized
agaucccaacuagacaaag

SEQ ID NO: 1210 - RNA, 19 nt, artificial
  Chemically synthesized
uggagguucacacaccucu

SEQ ID NO: 1211 - RNA, 19 nt, artificial
  Chemically synthesized
ucagaugacuuacauucug

SEQ ID NO: 1212 - RNA, 19 nt, artificial
  Chemically synthesized
ucaaguuuuucagagugag

SEQ ID NO: 1213 - RNA, 19 nt, artificial
  Chemically synthesized
caaacuuuuuggcucauag

SEQ ID NO: 1214 - RNA, 19 nt, artificial
  Chemically synthesized
ucacaaaguuuucagaaag

SEQ ID NO: 1215 - RNA, 19 nt, artificial
  Chemically synthesized
agucaccugagagaacgcc

SEQ ID NO: 1216 - RNA, 19 nt, artificial
  Chemically synthesized
aaguucuccagcuccugga

SEQ ID NO: 1217 - RNA, 19 nt, artificial
  Chemically synthesized
uccugugacauuccgacac

SEQ ID NO: 1218 - RNA, 19 nt, artificial
  Chemically synthesized
aacucuuucuguaagugaa

SEQ ID NO: 1219 - RNA, 19 nt, artificial
  Chemically synthesized
uucauuugugcuguuuccu

SEQ ID NO: 1220 - RNA, 19 nt, artificial
  Chemically synthesized
ugugaaaguaaacaaggaa

SEQ ID NO: 1221 - RNA, 19 nt, artificial
  Chemically synthesized
ugcaccacucacucuucac

SEQ ID NO: 1222 - RNA, 19 nt, artificial
  Chemically synthesized
aaugacacagucauugaga

SEQ ID NO: 1223 - RNA, 19 nt, artificial
  Chemically synthesized
uuuuccaaugaugccaaau

SEQ ID NO: 1224 - RNA, 19 nt, artificial
  Chemically synthesized
uugcuacagauuacaguug

SEQ ID NO: 1225 - RNA, 19 nt, artificial
  Chemically synthesized
uguugcucuugagaucagc

SEQ ID NO: 1226 - RNA, 19 nt, artificial
  Chemically synthesized
uuucauauaccacaggcca

SEQ ID NO: 1227 - RNA, 19 nt, artificial
  Chemically synthesized
aucaugguuaucucauaga

SEQ ID NO: 1228 - RNA, 19 nt, artificial
  Chemically synthesized
gcaaugggcacaaugagcc

SEQ ID NO: 1229 - RNA, 19 nt, artificial
  Chemically synthesized
caaaugaaguuauugccac

SEQ ID NO: 1230 - RNA, 19 nt, artificial
  Chemically synthesized
gugaaaguaaacaaggaac

SEQ ID NO: 1231 - RNA, 19 nt, artificial
  Chemically synthesized
uguuaauuccauuggaugu

SEQ ID NO: 1232 - RNA, 19 nt, artificial
  Chemically synthesized
cuuaugaagacacaacuug

SEQ ID NO: 1233 - RNA, 19 nt, artificial
  Chemically synthesized
guuuucagaaagcacaaag

SEQ ID NO: 1234 - RNA, 19 nt, artificial
  Chemically synthesized
ugaaaugagucaaguugcu

SEQ ID NO: 1235 - RNA, 19 nt, artificial
  Chemically synthesized
ugcucuugagaucagcugc

SEQ ID NO: 1236 - RNA, 19 nt, artificial
  Chemically synthesized
agcucuguagaucugaagc

SEQ ID NO: 1237 - RNA, 19 nt, artificial
  Chemically synthesized
agucaaccaacuguggauc

SEQ ID NO: 1238 - RNA, 19 nt, artificial
  Chemically synthesized
aucagaugacuuacauucu

SEQ ID NO: 1239 - RNA, 19 nt, artificial
  Chemically synthesized
aucuuagugaaggugucca

SEQ ID NO: 1240 - RNA, 19 nt, artificial
  Chemically synthesized
agaagaaugagaauggcag

SEQ ID NO: 1241 - RNA, 19 nt, artificial
  Chemically synthesized
auggcagcaucauuguucu

SEQ ID NO: 1242 - RNA, 19 nt, artificial
  Chemically synthesized
agucacuauaggucuccuu

SEQ ID NO: 1243 - RNA, 19 nt, artificial
  Chemically synthesized
uccuacugauuuucaauac

SEQ ID NO: 1244 - RNA, 19 nt, artificial
  Chemically synthesized
ugauuggaggauucuuccu

SEQ ID NO: 1245 - RNA, 19 nt, artificial
  Chemically synthesized
agagaagccugauuggagg

SEQ ID NO: 1246 - RNA, 19 nt, artificial
  Chemically synthesized
uuucacugagauccaagua

SEQ ID NO: 1247 - RNA, 19 nt, artificial
  Chemically synthesized
uaucucgcaguuccaaaca

SEQ ID NO: 1248 - RNA, 19 nt, artificial
  Chemically synthesized
uuaucgcagcucucagauu

SEQ ID NO: 1249 - RNA, 19 nt, artificial
  Chemically synthesized
uggaugucagcaccagagc

SEQ ID NO: 1250 - RNA, 19 nt, artificial
  Chemically synthesized
augaagacacaacuugaag

SEQ ID NO: 1251 - RNA, 19 nt, artificial
  Chemically synthesized
uuccuuggagaggcugaug

SEQ ID NO: 1252 - RNA, 19 nt, artificial
  Chemically synthesized
aacagagcacagcacaugc

SEQ ID NO: 1253 - RNA, 19 nt, artificial
  Chemically synthesized
cuugcagauaccauugcgg

SEQ ID NO: 1254 - RNA, 19 nt, artificial
  Chemically synthesized
caaaguuuucagaaagcac

SEQ ID NO: 1255 - RNA, 19 nt, artificial
  Chemically synthesized
agaacgccgagcagccgcc

SEQ ID NO: 1256 - RNA, 19 nt, artificial
  Chemically synthesized
aacuccgagcagucaccug

SEQ ID NO: 1257 - RNA, 19 nt, artificial
  Chemically synthesized
ucugcauccaugaagucaa

SEQ ID NO: 1258 - RNA, 19 nt, artificial
  Chemically synthesized
uggcccucuauauccaugg

SEQ ID NO: 1259 - RNA, 19 nt, artificial
  Chemically synthesized
auauccauggguucugcau

SEQ ID NO: 1260 - RNA, 19 nt, artificial
  Chemically synthesized
ugcauuccuacugauuuuc

SEQ ID NO: 1261 - RNA, 19 nt, artificial
  Chemically synthesized
aaugcaucauagcagaugu

SEQ ID NO: 1262 - RNA, 19 nt, artificial
  Chemically synthesized
aagucaaccaacuguggau

SEQ ID NO: 1263 - RNA, 19 nt, artificial
  Chemically synthesized
aaaugggagaaguccaguu

SEQ ID NO: 1264 - RNA, 19 nt, artificial
  Chemically synthesized
uucucaucaaaaagacgga

SEQ ID NO: 1265 - RNA, 19 nt, artificial
  Chemically synthesized
agaugcucuaaaauuacca

SEQ ID NO: 1266 - RNA, 19 nt, artificial
  Chemically synthesized
agaaaaaagagauguuucc

SEQ ID NO: 1267 - RNA, 19 nt, artificial
  Chemically synthesized
uuuggcucauagcucugua

SEQ ID NO: 1268 - RNA, 19 nt, artificial
  Chemically synthesized
ucaaguauucuucaaccau

SEQ ID NO: 1269 - RNA, 19 nt, artificial
  Chemically synthesized
ucuuaaguucauuugugcu

SEQ ID NO: 1270 - RNA, 19 nt, artificial
  Chemically synthesized
gacuggucuuaaauauggg

SEQ ID NO: 1271 - RNA, 19 nt, artificial
  Chemically synthesized
agaggagucucuuagcagg

SEQ ID NO: 1272 - RNA, 19 nt, artificial
  Chemically synthesized
agugaauauaaagugcuca

SEQ ID NO: 1273 - RNA, 19 nt, artificial
  Chemically synthesized
guaagugaauauaaagugc

SEQ ID NO: 1274 - RNA, 19 nt, artificial
  Chemically synthesized
acagucaucaaacucuaau

SEQ ID NO: 1275 - RNA, 19 nt, artificial
  Chemically synthesized
aagccugauuggaggauuc

SEQ ID NO: 1276 - RNA, 19 nt, artificial
  Chemically synthesized
ucaucggugauuuucacau

SEQ ID NO: 1277 - RNA, 19 nt, artificial
  Chemically synthesized
aggucuccuuuggauccug

SEQ ID NO: 1278 - RNA, 19 nt, artificial
  Chemically synthesized
aaccaauucccuuggauac

SEQ ID NO: 1279 - RNA, 19 nt, artificial
  Chemically synthesized
uugugagaugagaaaaaag

SEQ ID NO: 1280 - RNA, 19 nt, artificial
  Chemically synthesized
ucagaugcucuaaaauuac

SEQ ID NO: 1281 - RNA, 19 nt, artificial
  Chemically synthesized
guaucucgcaguuccaaac

SEQ ID NO: 1282 - RNA, 19 nt, artificial
  Chemically synthesized
gcuuccaaagucuucagug

SEQ ID NO: 1283 - RNA, 19 nt, artificial
  Chemically synthesized
guguucauuaucuuccgca

SEQ ID NO: 1284 - RNA, 19 nt, artificial
  Chemically synthesized
acucugucauuaucagaug

SEQ ID NO: 1285 - RNA, 19 nt, artificial
  Chemically synthesized
ucaggauuugcaauuuugu

SEQ ID NO: 1286 - RNA, 19 nt, artificial
  Chemically synthesized
acucucaggauuugcaauu

SEQ ID NO: 1287 - RNA, 19 nt, artificial
  Chemically synthesized
acaucuaaaauuuccagug

SEQ ID NO: 1288 - RNA, 19 nt, artificial
  Chemically synthesized
uugcuccuuagaaaacgua

SEQ ID NO: 1289 - RNA, 19 nt, artificial
  Chemically synthesized
acuccagguaggucuuggu

SEQ ID NO: 1290 - RNA, 19 nt, artificial
  Chemically synthesized
auccaugaagucaaccaac

SEQ ID NO: 1291 - RNA, 19 nt, artificial
  Chemically synthesized
ucaugguuaucucauagaa

SEQ ID NO: 1292 - RNA, 19 nt, artificial
  Chemically synthesized
uagcagauguuccugcugg

SEQ ID NO: 1293 - RNA, 19 nt, artificial
  Chemically synthesized
aaccagaaaaacuuuacug

SEQ ID NO: 1294 - RNA, 19 nt, artificial
  Chemically synthesized
aagugaauauaaagugcuc

SEQ ID NO: 1295 - RNA, 19 nt, artificial
  Chemically synthesized
auucacaggagcaaaugaa

SEQ ID NO: 1296 - RNA, 19 nt, artificial
  Chemically synthesized
agcuccuggaccauaaggu

SEQ ID NO: 1297 - RNA, 19 nt, artificial
  Chemically synthesized
uccuggaccauaagguucu

SEQ ID NO: 1298 - RNA, 19 nt, artificial
  Chemically synthesized
auugccaccagcuuccaaa

SEQ ID NO: 1299 - RNA, 19 nt, artificial
  Chemically synthesized
uuaguaagcaaguccucaa

SEQ ID NO: 1300 - RNA, 19 nt, artificial
  Chemically synthesized
aaaguguccaaaucaguau

SEQ ID NO: 1301 - RNA, 19 nt, artificial
  Chemically synthesized
agaaucuuccucuauugug

SEQ ID NO: 1302 - RNA, 19 nt, artificial
  Chemically synthesized
acauaaagaucccaacuag

SEQ ID NO: 1303 - RNA, 19 nt, artificial
  Chemically synthesized
uuguggcucuuuucaaugg

SEQ ID NO: 1304 - RNA, 19 nt, artificial
  Chemically synthesized
cuucagugugugaaaugag

SEQ ID NO: 1305 - RNA, 19 nt, artificial
  Chemically synthesized
auugcauuccuacugauuu

SEQ ID NO: 1306 - RNA, 19 nt, artificial
  Chemically synthesized
cacuuggucacuaagagcu

SEQ ID NO: 1307 - RNA, 19 nt, artificial
  Chemically synthesized
ugcuguuuccuaaugaacu

SEQ ID NO: 1308 - RNA, 19 nt, artificial
  Chemically synthesized
ugaaaaauggaaagugucc

SEQ ID NO: 1309 - RNA, 19 nt, artificial
  Chemically synthesized
gaauguuaaagaagaaagg

SEQ ID NO: 1310 - RNA, 19 nt, artificial
  Chemically synthesized
uuugcuggccaaucaauca

SEQ ID NO: 1311 - RNA, 19 nt, artificial
  Chemically synthesized
ucgugugcuggauaaguuc

SEQ ID NO: 1312 - RNA, 19 nt, artificial
  Chemically synthesized
acuccauuaaggguacagu

SEQ ID NO: 1313 - RNA, 19 nt, artificial
  Chemically synthesized
ucuugguguucauuaucuu

SEQ ID NO: 1314 - RNA, 19 nt, artificial
  Chemically synthesized
cacuccagguaggucuugg

SEQ ID NO: 1315 - RNA, 19 nt, artificial
  Chemically synthesized
aggauuugcaauuuuguga

SEQ ID NO: 1316 - RNA, 19 nt, artificial
  Chemically synthesized
uaagcaaguccucaaauga

SEQ ID NO: 1317 - RNA, 19 nt, artificial
  Chemically synthesized
uagugacauaaagauccca

SEQ ID NO: 1318 - RNA, 19 nt, artificial
  Chemically synthesized
ugagagaacgccgagcagc

SEQ ID NO: 1319 - RNA, 19 nt, artificial
  Chemically synthesized
ucaucaacuuauuucugga

SEQ ID NO: 1320 - RNA, 19 nt, artificial
  Chemically synthesized
uucaucggugauuuucaca

SEQ ID NO: 1321 - RNA, 19 nt, artificial
  Chemically synthesized
ccaacuagacaaagacugg

SEQ ID NO: 1322 - RNA, 19 nt, artificial
  Chemically synthesized
cuuuuuggcucauagcucu

SEQ ID NO: 1323 - RNA, 19 nt, artificial
  Chemically synthesized
agacuuaugaucaugguua

SEQ ID NO: 1324 - RNA, 19 nt, artificial
  Chemically synthesized
gugaaggagaggaauucac

SEQ ID NO: 1325 - RNA, 19 nt, artificial
  Chemically synthesized
cacaucauuuucauauacc

SEQ ID NO: 1326 - RNA, 19 nt, artificial
  Chemically synthesized
ugcugcuccugagugaagg

SEQ ID NO: 1327 - RNA, 19 nt, artificial
  Chemically synthesized
uguuguuggacaggucaag

SEQ ID NO: 1328 - RNA, 19 nt, artificial
  Chemically synthesized
aaugaauuuguuucaccag

SEQ ID NO: 1329 - RNA, 19 nt, artificial
  Chemically synthesized
uacuugcaccacucacucu

SEQ ID NO: 1330 - RNA, 19 nt, artificial
  Chemically synthesized
auuucaucuuuucuggcca

SEQ ID NO: 1331 - RNA, 19 nt, artificial
  Chemically synthesized
ugcuacagauuacaguugg

SEQ ID NO: 1332 - RNA, 19 nt, artificial
  Chemically synthesized
aucagcugcacagagaagu

SEQ ID NO: 1333 - RNA, 19 nt, artificial
  Chemically synthesized
aaugaaguuauugccacca

SEQ ID NO: 1334 - RNA, 19 nt, artificial
  Chemically synthesized
uuccaaugaugccaaauga

SEQ ID NO: 1335 - RNA, 19 nt, artificial
  Chemically synthesized
cauaagguucuccacccag

SEQ ID NO: 1336 - RNA, 19 nt, artificial
  Chemically synthesized
auuuguuucaccaguggau

SEQ ID NO: 1337 - RNA, 19 nt, artificial
  Chemically synthesized
ucccaacuagacaaagacu

SEQ ID NO: 1338 - RNA, 19 nt, artificial
  Chemically synthesized
aauugagauuguuguugcu

SEQ ID NO: 1339 - RNA, 19 nt, artificial
  Chemically synthesized
aguucuuugaguugcggca

SEQ ID NO: 1340 - RNA, 19 nt, artificial
  Chemically synthesized
uaccuggaucuauaacucu

SEQ ID NO: 1341 - RNA, 19 nt, artificial
  Chemically synthesized
auugucaaugauccacuug

SEQ ID NO: 1342 - RNA, 19 nt, artificial
  Chemically synthesized
uaccauugcggucacaaga

SEQ ID NO: 1343 - RNA, 19 nt, artificial
  Chemically synthesized
acuuuaucgcagcucucag

SEQ ID NO: 1344 - RNA, 19 nt, artificial
  Chemically synthesized
gaagacacaacuugaaggg

SEQ ID NO: 1345 - RNA, 19 nt, artificial
  Chemically synthesized
cuacagauuacaguuggcc

SEQ ID NO: 1346 - RNA, 19 nt, artificial
  Chemically synthesized
guuaauuccauuggauguc

SEQ ID NO: 1347 - RNA, 19 nt, artificial
  Chemically synthesized
gugaaaugagucaaguugc

SEQ ID NO: 1348 - RNA, 19 nt, artificial
  Chemically synthesized
ugucugaaugaacuuaacu

SEQ ID NO: 1349 - RNA, 19 nt, artificial
  Chemically synthesized
acuuucaucggugauuuuc

SEQ ID NO: 1350 - RNA, 19 nt, artificial
  Chemically synthesized
acagcuagguaggacagag

SEQ ID NO: 1351 - RNA, 19 nt, artificial
  Chemically synthesized
uauguggcauuguccagug

SEQ ID NO: 1352 - RNA, 19 nt, artificial
  Chemically synthesized
uauuucccacucucaggau

SEQ ID NO: 1353 - RNA, 19 nt, artificial
  Chemically synthesized
gcuuuuuucucaaugggcu

SEQ ID NO: 1354 - RNA, 19 nt, artificial
  Chemically synthesized
agucuaaauguucaagacu

SEQ ID NO: 1355 - RNA, 19 nt, artificial
  Chemically synthesized
aagacccacaccauccaca

SEQ ID NO: 1356 - RNA, 19 nt, artificial
  Chemically synthesized
uuuguuucaccaguggaua

SEQ ID NO: 1357 - RNA, 19 nt, artificial
  Chemically synthesized
ugugugaaaugagucaagu

SEQ ID NO: 1358 - RNA, 19 nt, artificial
  Chemically synthesized
ugcaucauagcagauguuc

SEQ ID NO: 1359 - RNA, 19 nt, artificial
  Chemically synthesized
agaaaaagaaucuuccucu

SEQ ID NO: 1360 - RNA, 19 nt, artificial
  Chemically synthesized
cuuaaauaugggaaccuag

SEQ ID NO: 1361 - RNA, 19 nt, artificial
  Chemically synthesized
aaacuuucaucggugauuu

SEQ ID NO: 1362 - RNA, 19 nt, artificial
  Chemically synthesized
aagaaaaagaaucuuccuc

SEQ ID NO: 1363 - RNA, 19 nt, artificial
  Chemically synthesized
cacaaagacaguuuugugg

SEQ ID NO: 1364 - RNA, 19 nt, artificial
  Chemically synthesized
agucauugagaaucuuaag

SEQ ID NO: 1365 - RNA, 19 nt, artificial
  Chemically synthesized
uuuuguggccacagaggag

SEQ ID NO: 1366 - RNA, 19 nt, artificial
  Chemically synthesized
ugauccacuugccaggaau

SEQ ID NO: 1367 - RNA, 19 nt, artificial
  Chemically synthesized
aucagcaggaacagagcac

SEQ ID NO: 1368 - RNA, 19 nt, artificial
  Chemically synthesized
ugauccuguuguuggacag

SEQ ID NO: 1369 - RNA, 19 nt, artificial
  Chemically synthesized
cagagaaugccuuuugugg

SEQ ID NO: 1370 - RNA, 19 nt, artificial
  Chemically synthesized
acggaaaugggagaagucc

SEQ ID NO: 1371 - RNA, 19 nt, artificial
  Chemically synthesized
ugggagaacuccgagcagu

SEQ ID NO: 1372 - RNA, 19 nt, artificial
  Chemically synthesized
ucuaacaauccagaaaucu

SEQ ID NO: 1373 - RNA, 19 nt, artificial
  Chemically synthesized
guucuccagcuccuggacc

SEQ ID NO: 1374 - RNA, 19 nt, artificial
  Chemically synthesized
aagagcaaugggcacaaug

SEQ ID NO: 1375 - RNA, 19 nt, artificial
  Chemically synthesized
augaugccaaaugauuuug

SEQ ID NO: 1376 - RNA, 19 nt, artificial
  Chemically synthesized
ugaucaugguuaucucaua

SEQ ID NO: 1377 - RNA, 19 nt, artificial
  Chemically synthesized
acuuggucacuaagagcuc

SEQ ID NO: 1378 - RNA, 19 nt, artificial
  Chemically synthesized
ugcacagagaagugacagc

SEQ ID NO: 1379 - RNA, 19 nt, artificial
  Chemically synthesized
ggauccugcaaccaauucc

SEQ ID NO: 1380 - RNA, 19 nt, artificial
  Chemically synthesized
ccucaaggaagguaagucc

SEQ ID NO: 1381 - RNA, 19 nt, artificial
  Chemically synthesized
uaagagggaggcaucuggu

SEQ ID NO: 1382 - RNA, 19 nt, artificial
  Chemically synthesized
uccaugaagucaaccaacu

SEQ ID NO: 1383 - RNA, 19 nt, artificial
  Chemically synthesized
uugagauuguuguugcuaa

SEQ ID NO: 1384 - RNA, 19 nt, artificial
  Chemically synthesized
caaccaucaaauuuucacu

SEQ ID NO: 1385 - RNA, 19 nt, artificial
  Chemically synthesized
ucaaggaagguaaguccag

SEQ ID NO: 1386 - RNA, 19 nt, artificial
  Chemically synthesized
ucacaggcugaauuuuuca

SEQ ID NO: 1387 - RNA, 19 nt, artificial
  Chemically synthesized
uuucaucuuuucuggccac

SEQ ID NO: 1388 - RNA, 19 nt, artificial
  Chemically synthesized
cuucugugagcccugaggg

SEQ ID NO: 1389 - RNA, 19 nt, artificial
  Chemically synthesized
ccuuggaauaugcagccuc

SEQ ID NO: 1390 - RNA, 19 nt, artificial
  Chemically synthesized
uuccgacaccgagaggcgg

SEQ ID NO: 1391 - RNA, 19 nt, artificial
  Chemically synthesized
accaauucccuuggauacc

SEQ ID NO: 1392 - RNA, 19 nt, artificial
  Chemically synthesized
accaauuuuuaaaucuggc

SEQ ID NO: 1393 - RNA, 19 nt, artificial
  Chemically synthesized
ucaccaguggauaguucug

SEQ ID NO: 1394 - RNA, 19 nt, artificial
  Chemically synthesized
cuuaacuauaacuagugac

SEQ ID NO: 1395 - RNA, 19 nt, artificial
  Chemically synthesized
uguaggucacuguugcuaa

SEQ ID NO: 1396 - RNA, 19 nt, artificial
  Chemically synthesized
accaacuccauuaagggua

SEQ ID NO: 1397 - RNA, 19 nt, artificial
  Chemically synthesized
ucaaaugacgguacaucca

SEQ ID NO: 1398 - RNA, 19 nt, artificial
  Chemically synthesized
aguucugaaaaauggaaag

SEQ ID NO: 1399 - RNA, 19 nt, artificial
  Chemically synthesized
gucuccuuuggauccugcu

SEQ ID NO: 1400 - RNA, 19 nt, artificial
  Chemically synthesized
aacauggguaagagggagg

SEQ ID NO: 1401 - RNA, 19 nt, artificial
  Chemically synthesized
cucuucacaaaguuuucag

SEQ ID NO: 1402 - RNA, 19 nt, artificial
  Chemically synthesized
uccagugucuugggaaugc

SEQ ID NO: 1403 - RNA, 19 nt, artificial
  Chemically synthesized
uugcaauuuugugagauga

SEQ ID NO: 1404 - RNA, 19 nt, artificial
  Chemically synthesized
cagauaucaguaauagacu

SEQ ID NO: 1405 - RNA, 19 nt, artificial
  Chemically synthesized
ucuucacaaaguuuucaga

SEQ ID NO: 1406 - RNA, 19 nt, artificial
  Chemically synthesized
gcaucauagcagauguucc

SEQ ID NO: 1407 - RNA, 19 nt, artificial
  Chemically synthesized
uucuaacaauccagaaauc

SEQ ID NO: 1408 - RNA, 19 nt, artificial
  Chemically synthesized
gguacagucaucaaacucu

SEQ ID NO: 1409 - RNA, 19 nt, artificial
  Chemically synthesized
ugugagaugagaaaaaaga

SEQ ID NO: 1410 - RNA, 19 nt, artificial
  Chemically synthesized
uucauacuugcaccacuca

SEQ ID NO: 1411 - RNA, 19 nt, artificial
  Chemically synthesized
uagucaaguuuuucagagu

SEQ ID NO: 1412 - RNA, 19 nt, artificial
  Chemically synthesized
acccacaccauccacaaag

SEQ ID NO: 1413 - RNA, 19 nt, artificial
  Chemically synthesized
caacaccaaacacugggag

SEQ ID NO: 1414 - RNA, 19 nt, artificial
  Chemically synthesized
uuuguggccacagaggagu

SEQ ID NO: 1415 - RNA, 19 nt, artificial
  Chemically synthesized
uacaaaaaucuccagcagu

SEQ ID NO: 1416 - RNA, 19 nt, artificial
  Chemically synthesized
uaaggauuucccaguaagu

SEQ ID NO: 1417 - RNA, 19 nt, artificial
  Chemically synthesized
aaggaagguaaguccagca

SEQ ID NO: 1418 - RNA, 19 nt, artificial
  Chemically synthesized
ucucgcaguuccaaacauu

SEQ ID NO: 1419 - RNA, 19 nt, artificial
  Chemically synthesized
uaccaacuccauuaagggu

SEQ ID NO: 1420 - RNA, 19 nt, artificial
  Chemically synthesized
aacuaccaguugaaagcag

SEQ ID NO: 1421 - RNA, 19 nt, artificial
  Chemically synthesized
caacuagacaaagacuggu

SEQ ID NO: 1422 - RNA, 19 nt, artificial
  Chemically synthesized
cuagugacauaaagauccc

SEQ ID NO: 1423 - RNA, 19 nt, artificial
  Chemically synthesized
aaguccagcaaaaucuuuu

SEQ ID NO: 1424 - RNA, 19 nt, artificial
  Chemically synthesized
agcaaugggcacaaugagc

SEQ ID NO: 1425 - RNA, 19 nt, artificial
  Chemically synthesized
uccuuggagaggcugauga

SEQ ID NO: 1426 - RNA, 19 nt, artificial
  Chemically synthesized
acaaggaaccagaaaaacu

SEQ ID NO: 1427 - RNA, 19 nt, artificial
  Chemically synthesized
ugcaauuuugugagaugag

SEQ ID NO: 1428 - RNA, 19 nt, artificial
  Chemically synthesized
uggauaguucugaaaaaug

SEQ ID NO: 1429 - RNA, 19 nt, artificial
  Chemically synthesized
gaaaugagucaaguugcuc

SEQ ID NO: 1430 - RNA, 19 nt, artificial
  Chemically synthesized
ggagucacuauaggucucc

SEQ ID NO: 1431 - RNA, 19 nt, artificial
  Chemically synthesized
acuggucuuaaauauggga

SEQ ID NO: 1432 - RNA, 19 nt, artificial
  Chemically synthesized
uagagagggccaggcaucc

SEQ ID NO: 1433 - RNA, 19 nt, artificial
  Chemically synthesized
cuauauccauggguucugc

SEQ ID NO: 1434 - RNA, 19 nt, artificial
  Chemically synthesized
ugagaucagcugcacagag

SEQ ID NO: 1435 - RNA, 19 nt, artificial
  Chemically synthesized
ucaauggagucaaugauau

SEQ ID NO: 1436 - RNA, 19 nt, artificial
  Chemically synthesized
uuucaggcauagaaugaaa

SEQ ID NO: 1437 - RNA, 19 nt, artificial
  Chemically synthesized
uuuccagugucuugggaau

SEQ ID NO: 1438 - RNA, 19 nt, artificial
  Chemically synthesized
cuauaggucuccuuuggau

SEQ ID NO: 1439 - RNA, 19 nt, artificial
  Chemically synthesized
augaacuaagccaguugcu

SEQ ID NO: 1440 - RNA, 19 nt, artificial
  Chemically synthesized
aagguucuccacccaguag

SEQ ID NO: 1441 - RNA, 19 nt, artificial
  Chemically synthesized
uugccaccagcuuccaaag

SEQ ID NO: 1442 - RNA, 19 nt, artificial
  Chemically synthesized
auaugcugcuucauaugaa

SEQ ID NO: 1443 - RNA, 19 nt, artificial
  Chemically synthesized
gagaauggcagcaucauug

SEQ ID NO: 1444 - RNA, 19 nt, artificial
  Chemically synthesized
gaacuaagccaguugcuac

SEQ ID NO: 1445 - RNA, 19 nt, artificial
  Chemically synthesized
uuguuucaccaguggauag

SEQ ID NO: 1446 - RNA, 19 nt, artificial
  Chemically synthesized
acaccucuguaggucacug

SEQ ID NO: 1447 - RNA, 19 nt, artificial
  Chemically synthesized
gagcaaaugaaguuauugc

SEQ ID NO: 1448 - RNA, 19 nt, Artificial Sequence
  Chemically synthesized
guuuuuuccaaugaugcca

SEQ ID NO: 1449 - RNA, 19 nt, artificial
  Chemically synthesized
gcccauugagaaaaaagcc

SEQ ID NO: 1450 - RNA, 19 nt, artificial
  Chemically synthesized
agcucaggaucuuuaaacu

SEQ ID NO: 1451 - RNA, 19 nt, artificial
  Chemically synthesized
gguccugugccaccguuuc

SEQ ID NO: 1452 - RNA, 19 nt, artificial
  Chemically synthesized
gcaacagugaccuacagag

SEQ ID NO: 1453 - RNA, 19 nt, artificial
  Chemically synthesized
aguguaacaggcugcauuc

SEQ ID NO: 1454 - RNA, 19 nt, artificial
  Chemically synthesized
acaaguuccguggaauguu

SEQ ID NO: 1455 - RNA, 19 nt, artificial
  Chemically synthesized
gaaaugugaaaaucaccga

SEQ ID NO: 1456 - RNA, 19 nt, artificial
  Chemically synthesized
gggaaauauggacaccuuc

SEQ ID NO: 1457 - RNA, 19 nt, artificial
  Chemically synthesized
uggaucauugacaauauca

SEQ ID NO: 1458 - RNA, 19 nt, artificial
  Chemically synthesized
gacaccuucacuaagauuc

SEQ ID NO: 1459 - RNA, 19 nt, artificial
  Chemically synthesized
caggcugcauucccaagac

SEQ ID NO: 1460 - RNA, 19 nt, artificial
  Chemically synthesized
uuuuacugcuggagauuuu

SEQ ID NO: 1461 - RNA, 19 nt, artificial
  Chemically synthesized
cauccaauggaauuaacac

SEQ ID NO: 1462 - RNA, 19 nt, artificial
  Chemically synthesized
ugacuguacccuuaaugga

SEQ ID NO: 1463 - RNA, 19 nt, artificial
  Chemically synthesized
acagugagcgggaugccua

SEQ ID NO: 1464 - RNA, 19 nt, artificial
  Chemically synthesized
gccuggcuccaggccaaaa

SEQ ID NO: 1465 - RNA, 19 nt, artificial
  Chemically synthesized
aggaucaccuacauuagca

SEQ ID NO: 1466 - RNA, 19 nt, artificial
  Chemically synthesized
uguaagucaucugauccuu

SEQ ID NO: 1467 - RNA, 19 nt, artificial
  Chemically synthesized
agauaaugaacaccaagac

SEQ ID NO: 1468 - RNA, 19 nt, artificial
  Chemically synthesized
aaguggaucauugacaaua

SEQ ID NO: 1469 - RNA, 19 nt, artificial
  Chemically synthesized
gcuccaggccaaaaggaag

SEQ ID NO: 1470 - RNA, 19 nt, artificial
  Chemically synthesized
gcugcggaagauaaugaac

SEQ ID NO: 1471 - RNA, 19 nt, artificial
  Chemically synthesized
gacaauaucauugacucca

SEQ ID NO: 1472 - RNA, 19 nt, artificial
  Chemically synthesized
auuuguuucuuacagugag

SEQ ID NO: 1473 - RNA, 19 nt, artificial
  Chemically synthesized
acugcgagauacugauuug

SEQ ID NO: 1474 - RNA, 19 nt, artificial
  Chemically synthesized
agauugaugcuucagaucu

SEQ ID NO: 1475 - RNA, 19 nt, artificial
  Chemically synthesized
ggccuggcuccaggccaaa

SEQ ID NO: 1476 - RNA, 19 nt, artificial
  Chemically synthesized
ucuggugcugacauccaau

SEQ ID NO: 1477 - RNA, 19 nt, artificial
  Chemically synthesized
gaugccuacuggguggaga

SEQ ID NO: 1478 - RNA, 19 nt, artificial
  Chemically synthesized
gagcuggagaacuucaauc

SEQ ID NO: 1479 - RNA, 19 nt, artificial
  Chemically synthesized
gaauacacaguguaacagg

SEQ ID NO: 1480 - RNA, 19 nt, artificial
  Chemically synthesized
cacaguguaacaggcugca

SEQ ID NO: 1481 - RNA, 19 nt, artificial
  Chemically synthesized
gguucaggauguccgccuc

SEQ ID NO: 1482 - RNA, 19 nt, artificial
  Chemically synthesized
agcaacagugaccuacaga

SEQ ID NO: 1483 - RNA, 19 nt, artificial
  Chemically synthesized
gacuguacccuuaauggag

SEQ ID NO: 1484 - RNA, 19 nt, artificial
  Chemically synthesized
gccacauacuuuguggaug

SEQ ID NO: 1485 - RNA, 19 nt, artificial
  Chemically synthesized
agauuuugcuggacuuacc

SEQ ID NO: 1486 - RNA, 19 nt, artificial
  Chemically synthesized
guuagcaacaacaaucuca

SEQ ID NO: 1487 - RNA, 19 nt, artificial
  Chemically synthesized
ggcuucucugucuugugac

SEQ ID NO: 1488 - RNA, 19 nt, artificial
  Chemically synthesized
ccagcaaauuaccugugug

SEQ ID NO: 1489 - RNA, 19 nt, artificial
  Chemically synthesized
aagagugaguggugcaagu

SEQ ID NO: 1490 - RNA, 19 nt, artificial
  Chemically synthesized
agaaauaaguugaugacuc

SEQ ID NO: 1491 - RNA, 19 nt, artificial
  Chemically synthesized
agacacuggaaauuuuaga

SEQ ID NO: 1492 - RNA, 19 nt, artificial
  Chemically synthesized
agggcagcucaggaucuuu

SEQ ID NO: 1493 - RNA, 19 nt, artificial
  Chemically synthesized
ggaaauccuuacaaaaccc

SEQ ID NO: 1494 - RNA, 19 nt, artificial
  Chemically synthesized
ucagccucuccaaggaaga

SEQ ID NO: 1495 - RNA, 19 nt, artificial
  Chemically synthesized
uaugaucugagcacuuuau

SEQ ID NO: 1496 - RNA, 19 nt, artificial
  Chemically synthesized
acuucauuugcuccuguga

SEQ ID NO: 1497 - RNA, 19 nt, artificial
  Chemically synthesized
ugcuuucugaaaacuuugu

SEQ ID NO: 1498 - RNA, 19 nt, artificial
  Chemically synthesized
agagccacaaaacugucuu

SEQ ID NO: 1499 - RNA, 19 nt, artificial
  Chemically synthesized
gcacuggugucuggcaugu

SEQ ID NO: 1500 - RNA, 19 nt, artificial
  Chemically synthesized
gguaaaucugagagcugcg

SEQ ID NO: 1501 - RNA, 19 nt, artificial
  Chemically synthesized
ggaagauucuuuuucuucc

SEQ ID NO: 1502 - RNA, 19 nt, artificial
  Chemically synthesized
gauccagguaaaguggaaa

SEQ ID NO: 1503 - RNA, 19 nt, artificial
  Chemically synthesized
guggaucauugacaauauc

SEQ ID NO: 1504 - RNA, 19 nt, artificial
  Chemically synthesized
aaggaagaauccuccaauc

SEQ ID NO: 1505 - RNA, 19 nt, artificial
  Chemically synthesized
cacgaauacacaguguaac

SEQ ID NO: 1506 - RNA, 19 nt, artificial
  Chemically synthesized
ucauaugaagcagcauauu

SEQ ID NO: 1507 - RNA, 19 nt, artificial
  Chemically synthesized
ucugcaagcugcggaagau

SEQ ID NO: 1508 - RNA, 19 nt, artificial
  Chemically synthesized
ccacauacuuuguggaugg

SEQ ID NO: 1509 - RNA, 19 nt, artificial
  Chemically synthesized
gaagacuuuggaagcuggu

SEQ ID NO: 1510 - RNA, 19 nt, artificial
  Chemically synthesized
uagcaacaacaaucucaau

SEQ ID NO: 1511 - RNA, 19 nt, artificial
  Chemically synthesized
gcuucucugucuugugacc

SEQ ID NO: 1512 - RNA, 19 nt, artificial
  Chemically synthesized
ugaagagugaguggugcaa

SEQ ID NO: 1513 - RNA, 19 nt, artificial
  Chemically synthesized
uccuucauaugaagcagca

SEQ ID NO: 1514 - RNA, 19 nt, artificial
  Chemically synthesized
uggaagcugguggcaauaa

SEQ ID NO: 1515 - RNA, 19 nt, artificial
  Chemically synthesized
ugccuggcccucucuacaa

SEQ ID NO: 1516 - RNA, 19 nt, artificial
  Chemically synthesized
caggccaaaaggaagccca

SEQ ID NO: 1517 - RNA, 19 nt, artificial
  Chemically synthesized
cugguggcaauaacuucau

SEQ ID NO: 1518 - RNA, 19 nt, artificial
  Chemically synthesized
cagaucuacagagcuauga

SEQ ID NO: 1519 - RNA, 19 nt, artificial
  Chemically synthesized
cagaaauaaguugaugacu

SEQ ID NO: 1520 - RNA, 19 nt, artificial
  Chemically synthesized
ugaagacuuuggaagcugg

SEQ ID NO: 1521 - RNA, 19 nt, artificial
  Chemically synthesized
cucaggagcagcaagcacu

SEQ ID NO: 1522 - RNA, 19 nt, artificial
  Chemically synthesized
gacacuggaaauuuuagau

SEQ ID NO: 1523 - RNA, 19 nt, artificial
  Chemically synthesized
auaaugaacaccaagaccu

SEQ ID NO: 1524 - RNA, 19 nt, artificial
  Chemically synthesized
guuaaaagaaucacaguag

SEQ ID NO: 1525 - RNA, 19 nt, artificial
  Chemically synthesized
uccacuggugaaacaaauu

SEQ ID NO: 1526 - RNA, 19 nt, artificial
  Chemically synthesized
uggaacugcgagauacuga

SEQ ID NO: 1527 - RNA, 19 nt, artificial
  Chemically synthesized
auuuuacugcuggagauuu

SEQ ID NO: 1528 - RNA, 19 nt, artificial
  Chemically synthesized
gaagauaaugaacaccaag

SEQ ID NO: 1529 - RNA, 19 nt, artificial
  Chemically synthesized
gccagcaaauuaccugugu

SEQ ID NO: 1530 - RNA, 19 nt, artificial
  Chemically synthesized
gacuucauuccuggcaagu

SEQ ID NO: 1531 - RNA, 19 nt, artificial
  Chemically synthesized
ugugcucuguuccugcuga

SEQ ID NO: 1532 - RNA, 19 nt, artificial
  Chemically synthesized
agcuggagaacuucaaucc

SEQ ID NO: 1533 - RNA, 19 nt, artificial
  Chemically synthesized
ucccaagacacuggaaauu

SEQ ID NO: 1534 - RNA, 19 nt, artificial
  Chemically synthesized
aauauggacaccuucacua

SEQ ID NO: 1535 - RNA, 19 nt, artificial
  Chemically synthesized
cuucauuccuggcaagugg

SEQ ID NO: 1536 - RNA, 19 nt, artificial
  Chemically synthesized
gaccuguccaacaacagga

SEQ ID NO: 1537 - RNA, 19 nt, artificial
  Chemically synthesized
uuaccuuccuugaggaacu

SEQ ID NO: 1538 - RNA, 19 nt, artificial
  Chemically synthesized
augaucugagcacuuuaua

SEQ ID NO: 1539 - RNA, 19 nt, artificial
  Chemically synthesized
aaauccuuacaaaacccua

SEQ ID NO: 1540 - RNA, 19 nt, artificial
  Chemically synthesized
ugaugacucuaccagaugc

SEQ ID NO: 1541 - RNA, 19 nt, artificial
  Chemically synthesized
aguaugaacuggacuucuc

SEQ ID NO: 1542 - RNA, 19 nt, artificial
  Chemically synthesized
uaaggagcaacuugacuca

SEQ ID NO: 1543 - RNA, 19 nt, artificial
  Chemically synthesized
cagaguuauagauccaggu

SEQ ID NO: 1544 - RNA, 19 nt, artificial
  Chemically synthesized
agccaaaaaguuugaaguc

SEQ ID NO: 1545 - RNA, 19 nt, artificial
  Chemically synthesized
gagauugaugcuucagauc

SEQ ID NO: 1546 - RNA, 19 nt, artificial
  Chemically synthesized
cuacauuagcaacagugac

SEQ ID NO: 1547 - RNA, 19 nt, artificial
  Chemically synthesized
uucuuaaacuuacugggaa

SEQ ID NO: 1548 - RNA, 19 nt, artificial
  Chemically synthesized
uugaugacuguacccuuaa

SEQ ID NO: 1549 - RNA, 19 nt, artificial
  Chemically synthesized
gugcaaguaugaacuggac

SEQ ID NO: 1550 - RNA, 19 nt, artificial
  Chemically synthesized
ugaaaacuuugugaagagu

SEQ ID NO: 1551 - RNA, 19 nt, artificial
  Chemically synthesized
ggaauuaacacaauagagg

SEQ ID NO: 1552 - RNA, 19 nt, artificial
  Chemically synthesized
gaggaacuugagauugaug

SEQ ID NO: 1553 - RNA, 19 nt, artificial
  Chemically synthesized
ccagaaauaaguugaugac

SEQ ID NO: 1554 - RNA, 19 nt, artificial
  Chemically synthesized
uuaacacaauagaggaaga

SEQ ID NO: 1555 - RNA, 19 nt, artificial
  Chemically synthesized
cagcacuggugucuggcau

SEQ ID NO: 1556 - RNA, 19 nt, artificial
  Chemically synthesized
cagcacacgaauacacagu

SEQ ID NO: 1557 - RNA, 19 nt, artificial
  Chemically synthesized
acuuauccagcacacgaau

SEQ ID NO: 1558 - RNA, 19 nt, artificial
  Chemically synthesized
guuuucuaaggagcaacuu

SEQ ID NO: 1559 - RNA, 19 nt, artificial
  Chemically synthesized
guccaggagcuggagaacu

SEQ ID NO: 1560 - RNA, 19 nt, artificial
  Chemically synthesized
aaaacugucuuugugcuuu

SEQ ID NO: 1561 - RNA, 19 nt, artificial
  Chemically synthesized
aacuugagauugaugcuuc

SEQ ID NO: 1562 - RNA, 19 nt, artificial
  Chemically synthesized
gggaaacaucucuuuuuuc

SEQ ID NO: 1563 - RNA, 19 nt, artificial
  Chemically synthesized
uggugaaacaaauucauug

SEQ ID NO: 1564 - RNA, 19 nt, artificial
  Chemically synthesized
ugucaguggccagaaaaga

SEQ ID NO: 1565 - RNA, 19 nt, artificial
  Chemically synthesized
caagcugcggaagauaaug

SEQ ID NO: 1566 - RNA, 19 nt, artificial
  Chemically synthesized
aauuagaguuugaugacug

SEQ ID NO: 1567 - RNA, 19 nt, artificial
  Chemically synthesized
ugaaaaucaccgaugaaag

SEQ ID NO: 1568 - RNA, 19 nt, artificial
  Chemically synthesized
aagucaucugauccuucau

SEQ ID NO: 1569 - RNA, 19 nt, artificial
  Chemically synthesized
ugaaaagagccacaaaacu

SEQ ID NO: 1570 - RNA, 19 nt, artificial
  Chemically synthesized
ucauuugcuccugugaauu

SEQ ID NO: 1571 - RNA, 19 nt, artificial
  Chemically synthesized
guuuuucugguuccuuguu

SEQ ID NO: 1572 - RNA, 19 nt, artificial
  Chemically synthesized
aguugugucuucauaagcg

SEQ ID NO: 1573 - RNA, 19 nt, artificial
  Chemically synthesized
cuucucccauuuccgucuu

SEQ ID NO: 1574 - RNA, 19 nt, artificial
  Chemically synthesized
acacuuuccauuuuucaga

SEQ ID NO: 1575 - RNA, 19 nt, artificial
  Chemically synthesized
aacugcgagauacugauuu

SEQ ID NO: 1576 - RNA, 19 nt, artificial
  Chemically synthesized
caggcuucucugucuugug

SEQ ID NO: 1577 - RNA, 19 nt, artificial
  Chemically synthesized
caaaacugucuuugugcuu

SEQ ID NO: 1578 - RNA, 19 nt, artificial
  Chemically synthesized
acuauccacuggugaaaca

SEQ ID NO: 1579 - RNA, 19 nt, artificial
  Chemically synthesized
cauugacaauaucauugac

SEQ ID NO: 1580 - RNA, 19 nt, artificial
  Chemically synthesized
ucauuagaauacuuggauc

SEQ ID NO: 1581 - RNA, 19 nt, artificial
  Chemically synthesized
ugggaaauccuuacaaaac

SEQ ID NO: 1582 - RNA, 19 nt, artificial
  Chemically synthesized
cuggugucuggcaugugcu

SEQ ID NO: 1583 - RNA, 19 nt, artificial
  Chemically synthesized
caagggcagcucaggaucu

SEQ ID NO: 1584 - RNA, 19 nt, artificial
  Chemically synthesized
uaaguugaugacucuacca

SEQ ID NO: 1585 - RNA, 19 nt, artificial
  Chemically synthesized
ucucuuuuuucucaucuca

SEQ ID NO: 1586 - RNA, 19 nt, artificial
  Chemically synthesized
uccuugaggaacuugagau

SEQ ID NO: 1587 - RNA, 19 nt, artificial
  Chemically synthesized
gcuggacuuaccuuccuug

SEQ ID NO: 1588 - RNA, 19 nt, artificial
  Chemically synthesized
ucauaagcgggacuucauu

SEQ ID NO: 1589 - RNA, 19 nt, artificial
  Chemically synthesized
ucuacagagcuaugagcca

SEQ ID NO: 1590 - RNA, 19 nt, artificial
  Chemically synthesized
cgggacuucauuccuggca

SEQ ID NO: 1591 - RNA, 19 nt, artificial
  Chemically synthesized
acuggugaaacaaauucau

SEQ ID NO: 1592 - RNA, 19 nt, artificial
  Chemically synthesized
aaagauuuugcuggacuua

SEQ ID NO: 1593 - RNA, 19 nt, artificial
  Chemically synthesized
aaaagagccacaaaacugu

SEQ ID NO: 1594 - RNA, 19 nt, artificial
  Chemically synthesized
acuccauugaaaagagcca

SEQ ID NO: 1595 - RNA, 19 nt, artificial
  Chemically synthesized
gagaacaaugaugcugcca

SEQ ID NO: 1596 - RNA, 19 nt, artificial
  Chemically synthesized
aagcugcggaagauaauga

SEQ ID NO: 1597 - RNA, 19 nt, artificial
  Chemically synthesized
gcagcauauuuuacugcug

SEQ ID NO: 1598 - RNA, 19 nt, artificial
  Chemically synthesized
gucaucaucagccucucca

SEQ ID NO: 1599 - RNA, 19 nt, artificial
  Chemically synthesized
uggcccucucuacaaacuu

SEQ ID NO: 1600 - RNA, 19 nt, artificial
  Chemically synthesized
cugcaagggcagcucagga

SEQ ID NO: 1601 - RNA, 19 nt, artificial
  Chemically synthesized
cuccaaucaggcuucucug

SEQ ID NO: 1602 - RNA, 19 nt, artificial
  Chemically synthesized
cuuacccauguuacuagua

SEQ ID NO: 1603 - RNA, 19 nt, artificial
  Chemically synthesized
gaaaagagccacaaaacug

SEQ ID NO: 1604 - RNA, 19 nt, artificial
  Chemically synthesized
caggaucuuuaaacuccau

SEQ ID NO: 1605 - RNA, 19 nt, artificial
  Chemically synthesized
ccugugccaccguuuccau

SEQ ID NO: 1606 - RNA, 19 nt, artificial
  Chemically synthesized
cguggaauguuuggaacug

SEQ ID NO: 1607 - RNA, 19 nt, artificial
  Chemically synthesized
cgcuucugcaagcugcgga

SEQ ID NO: 1608 - RNA, 19 nt, artificial
  Chemically synthesized
ggugucggaaugucacagg

SEQ ID NO: 1609 - RNA, 19 nt, artificial
  Chemically synthesized
auuuccgucuuuuugauga

SEQ ID NO: 1610 - RNA, 19 nt, artificial
  Chemically synthesized
cauugacuccauugaaaag

SEQ ID NO: 1611 - RNA, 19 nt, artificial
  Chemically synthesized
uauuugaacuuauccagca

SEQ ID NO: 1612 - RNA, 19 nt, artificial
  Chemically synthesized
gucuucauaagcgggacuu

SEQ ID NO: 1613 - RNA, 19 nt, artificial
  Chemically synthesized
guggagaaccuuauggucc

SEQ ID NO: 1614 - RNA, 19 nt, artificial
  Chemically synthesized
agcagcaagcacuggccaa

SEQ ID NO: 1615 - RNA, 19 nt, artificial
  Chemically synthesized
agcugguggcaauaacuuc

SEQ ID NO: 1616 - RNA, 19 nt, artificial
  Chemically synthesized
agcacuggugucuggcaug

SEQ ID NO: 1617 - RNA, 19 nt, artificial
  Chemically synthesized
acacaauagaggaagauuc

SEQ ID NO: 1618 - RNA, 19 nt, artificial
  Chemically synthesized
gaagcagcauauuuuacug

SEQ ID NO: 1619 - RNA, 19 nt, artificial
  Chemically synthesized
aacacaauagaggaagauu

SEQ ID NO: 1620 - RNA, 19 nt, artificial
  Chemically synthesized
cuggcaugugcugugcucu

SEQ ID NO: 1621 - RNA, 19 nt, artificial
  Chemically synthesized
cgaugaaaguuuguuucag

SEQ ID NO: 1622 - RNA, 19 nt, artificial
  Chemically synthesized
gauccuucauaugaagcag

SEQ ID NO: 1623 - RNA, 19 nt, artificial
  Chemically synthesized
uucagaucuacagagcuau

SEQ ID NO: 1624 - RNA, 19 nt, artificial
  Chemically synthesized
cacucugaaaaacuugacu

SEQ ID NO: 1625 - RNA, 19 nt, artificial
  Chemically synthesized
gaugagaacaaugaugcug

SEQ ID NO: 1626 - RNA, 19 nt, artificial
  Chemically synthesized
ggugucuggcaugugcugu

SEQ ID NO: 1627 - RNA, 19 nt, artificial
  Chemically synthesized
ugauccuucauaugaagca

SEQ ID NO: 1628 - RNA, 19 nt, artificial
  Chemically synthesized
gcugugcucuguuccugcu

SEQ ID NO: 1629 - RNA, 19 nt, artificial
  Chemically synthesized
cagauuucuggauuguuag

SEQ ID NO: 1630 - RNA, 19 nt, artificial
  Chemically synthesized
cuuaaacuuacugggaaau

SEQ ID NO: 1631 - RNA, 19 nt, artificial
  Chemically synthesized
aaagccuugaccuguccaa

SEQ ID NO: 1632 - RNA, 19 nt, artificial
  Chemically synthesized
ccagaugccucccucuuac

SEQ ID NO: 1633 - RNA, 19 nt, artificial
  Chemically synthesized
aacuuacugggaaauccuu

SEQ ID NO: 1634 - RNA, 19 nt, artificial
  Chemically synthesized
uucauaagcgggacuucau

SEQ ID NO: 1635 - RNA, 19 nt, artificial
  Chemically synthesized
ggauggugugggucuuggg

SEQ ID NO: 1636 - RNA, 19 nt, artificial
  Chemically synthesized
acaaaacugucuuugugcu

SEQ ID NO: 1637 - RNA, 19 nt, artificial
  Chemically synthesized
uuuggaacugcgagauacu

SEQ ID NO: 1638 - RNA, 19 nt, artificial
  Chemically synthesized
augccucccucuuacccau

SEQ ID NO: 1639 - RNA, 19 nt, artificial
  Chemically synthesized
cugaagacuuuggaagcug

SEQ ID NO: 1640 - RNA, 19 nt, artificial
  Chemically synthesized
gccucccucuuacccaugu

SEQ ID NO: 1641 - RNA, 19 nt, artificial
  Chemically synthesized
caguagaaaacaguaaagu

SEQ ID NO: 1642 - RNA, 19 nt, artificial
  Chemically synthesized
aagaaaagauuuugcugga

SEQ ID NO: 1643 - RNA, 19 nt, artificial
  Chemically synthesized
ucuuuaaacuccauucccu

SEQ ID NO: 1644 - RNA, 19 nt, artificial
  Chemically synthesized
gaauguuuggaacugcgag

SEQ ID NO: 1645 - RNA, 19 nt, artificial
  Chemically synthesized
aagaaucacaguagaaaac

SEQ ID NO: 1646 - RNA, 19 nt, artificial
  Chemically synthesized
cacucaggagcagcaagca

SEQ ID NO: 1647 - RNA, 19 nt, artificial
  Chemically synthesized
auguuuggaacugcgagau

SEQ ID NO: 1648 - RNA, 19 nt, artificial
  Chemically synthesized
ccaggagcuggagaacuuc

SEQ ID NO: 1649 - RNA, 19 nt, artificial
  Chemically synthesized
gccuacuggguggagaacc

SEQ ID NO: 1650 - RNA, 19 nt, artificial
  Chemically synthesized
agaucuacagagcuaugag

SEQ ID NO: 1651 - RNA, 19 nt, artificial
  Chemically synthesized
acaauccggaggcugcaua

SEQ ID NO: 1652 - RNA, 19 nt, artificial
  Chemically synthesized
ugaacaccaagaccuaccu

SEQ ID NO: 1653 - RNA, 19 nt, artificial
  Chemically synthesized
aaaaggaagcccaggaaag

SEQ ID NO: 1654 - RNA, 19 nt, artificial
  Chemically synthesized
ccauuuuucagaacuaucc

SEQ ID NO: 1655 - RNA, 19 nt, artificial
  Chemically synthesized
gaaaaauucagccugugag

SEQ ID NO: 1656 - RNA, 19 nt, artificial
  Chemically synthesized
uugagauugaugcuucaga

SEQ ID NO: 1657 - RNA, 19 nt, artificial
  Chemically synthesized
gaguuugaugacuguaccc

SEQ ID NO: 1658 - RNA, 19 nt, artificial
  Chemically synthesized
aacuuugugaagagugagu

SEQ ID NO: 1659 - RNA, 19 nt, artificial
  Chemically synthesized
uggaauuaacacaauagag

SEQ ID NO: 1660 - RNA, 19 nt, artificial
  Chemically synthesized
cagugagcgggaugccuac

SEQ ID NO: 1661 - RNA, 19 nt, artificial
  Chemically synthesized
acaguguaacaggcugcau

SEQ ID NO: 1662 - RNA, 19 nt, artificial
  Chemically synthesized
acaggcugcauucccaaga

SEQ ID NO: 1663 - RNA, 19 nt, artificial
  Chemically synthesized
ccuggcccucucuacaaac

SEQ ID NO: 1664 - RNA, 19 nt, artificial
  Chemically synthesized
ggucaucaucagccucucc

SEQ ID NO: 1665 - RNA, 19 nt, artificial
  Chemically synthesized
agcagcauauuuuacugcu

SEQ ID NO: 1666 - RNA, 19 nt, artificial
  Chemically synthesized
uuagaguuugaugacugua

SEQ ID NO: 1667 - RNA, 19 nt, artificial
  Chemically synthesized
caaguaugaacuggacuuc

SEQ ID NO: 1668 - RNA, 19 nt, artificial
  Chemically synthesized
aucaccuacauuagcaaca

SEQ ID NO: 1669 - RNA, 19 nt, artificial
  Chemically synthesized
guaaaucugagagcugcga

SEQ ID NO: 1670 - RNA, 19 nt, artificial
  Chemically synthesized
aaucacaguagaaaacagu

SEQ ID NO: 1671 - RNA, 19 nt, artificial
  Chemically synthesized
uucauuccuggcaagugga

SEQ ID NO: 1672 - RNA, 19 nt, artificial
  Chemically synthesized
uuugaugagaacaaugaug

SEQ ID NO: 1673 - RNA, 19 nt, artificial
  Chemically synthesized
gcuggagaacuucaauccc

SEQ ID NO: 1674 - RNA, 19 nt, artificial
  Chemically synthesized
agcgggacuucauuccugg

SEQ ID NO: 1675 - RNA, 19 nt, artificial
  Chemically synthesized
uaugagccaaaaaguuuga

SEQ ID NO: 1676 - RNA, 19 nt, artificial
  Chemically synthesized
gaaaacuuugugaagagug

SEQ ID NO: 1677 - RNA, 19 nt, artificial
  Chemically synthesized
gugucuucauaagcgggac

SEQ ID NO: 1678 - RNA, 19 nt, artificial
  Chemically synthesized
cucuccaaggaagaauccu

SEQ ID NO: 1679 - RNA, 19 nt, artificial
  Chemically synthesized
uaacaggcugcauucccaa

SEQ ID NO: 1680 - RNA, 19 nt, artificial
  Chemically synthesized
gggaugccuacugggugga

SEQ ID NO: 1681 - RNA, 19 nt, artificial
  Chemically synthesized
gauaaugaacaccaagacc

SEQ ID NO: 1682 - RNA, 19 nt, artificial
  Chemically synthesized
guaagucaucugauccuuc

SEQ ID NO: 1683 - RNA, 19 nt, artificial
  Chemically synthesized
guuccguggaauguuugga

SEQ ID NO: 1684 - RNA, 19 nt, artificial
  Chemically synthesized
ugcaagggcagcucaggau

SEQ ID NO: 1685 - RNA, 19 nt, artificial
  Chemically synthesized
ugaacuggacuucucccau

SEQ ID NO: 1686 - RNA, 19 nt, artificial
  Chemically synthesized
cauuugcuccugugaauuc

SEQ ID NO: 1687 - RNA, 19 nt, artificial
  Chemically synthesized
cuucacucaggagcagcaa

SEQ ID NO: 1688 - RNA, 19 nt, artificial
  Chemically synthesized
uccuggcaaguggaucauu

SEQ ID NO: 1689 - RNA, 19 nt, artificial
  Chemically synthesized
aucagauuucuggauuguu

SEQ ID NO: 1690 - RNA, 19 nt, artificial
  Chemically synthesized
uccauugaaaagagccaca

SEQ ID NO: 1691 - RNA, 19 nt, artificial
  Chemically synthesized
auugauuggccagcaaauu

SEQ ID NO: 1692 - RNA, 19 nt, artificial
  Chemically synthesized
ucaggaucuuuaaacucca

SEQ ID NO: 1693 - RNA, 19 nt, artificial
  Chemically synthesized
aacugucuuugugcuuucu

SEQ ID NO: 1694 - RNA, 19 nt, artificial
  Chemically synthesized
cuggugcugacauccaaug

SEQ ID NO: 1695 - RNA, 19 nt, artificial
  Chemically synthesized
caagcacuggccaaagucu

SEQ ID NO: 1696 - RNA, 19 nt, artificial
  Chemically synthesized
uccaaggaagaauccucca

SEQ ID NO: 1697 - RNA, 19 nt, artificial
  Chemically synthesized
uucagaauguaagucaucu

SEQ ID NO: 1698 - RNA, 19 nt, artificial
  Chemically synthesized
uauuuuacugcuggagauu

SEQ ID NO: 1699 - RNA, 19 nt, artificial
  Chemically synthesized
ucugauccuucauaugaag

SEQ ID NO: 1700 - RNA, 19 nt, artificial
  Chemically synthesized
cgaauacacaguguaacag

SEQ ID NO: 1701 - RNA, 19 nt, artificial
  Chemically synthesized
ggcucuggugcugacaucc

SEQ ID NO: 1702 - RNA, 19 nt, artificial
  Chemically synthesized
cacauacuuuguggauggu

SEQ ID NO: 1703 - RNA, 19 nt, artificial
  Chemically synthesized
gaugccucccucuuaccca

SEQ ID NO: 1704 - RNA, 19 nt, artificial
  Chemically synthesized
ccuugaccuguccaacaac

SEQ ID NO: 1705 - RNA, 19 nt, artificial
  Chemically synthesized
aaacuuacugggaaauccu

SEQ ID NO: 1706 - RNA, 19 nt, artificial
  Chemically synthesized
cuuccuugaggaacuugag

SEQ ID NO: 1707 - RNA, 19 nt, artificial
  Chemically synthesized
caaauuaccugugugacuc

SEQ ID NO: 1708 - RNA, 19 nt, artificial
  Chemically synthesized
acagugaccuacagaggug

SEQ ID NO: 1709 - RNA, 19 nt, artificial
  Chemically synthesized
gaaaagauuuugcuggacu

SEQ ID NO: 1710 - RNA, 19 nt, artificial
  Chemically synthesized
aaguaugaacuggacuucu

SEQ ID NO: 1711 - RNA, 19 nt, artificial
  Chemically synthesized
uugauuggccagcaaauua

SEQ ID NO: 1712 - RNA, 19 nt, artificial
  Chemically synthesized
gacucuaccagaugccucc

SEQ ID NO: 1713 - RNA, 19 nt, artificial
  Chemically synthesized
cuuacugggaaauccuuac

SEQ ID NO: 1714 - RNA, 19 nt, artificial
  Chemically synthesized
acuucucccauuuccgucu

SEQ ID NO: 1715 - RNA, 19 nt, artificial
  Chemically synthesized
ccagcacacgaauacacag

SEQ ID NO: 1716 - RNA, 19 nt, artificial
  Chemically synthesized
uucucaucucacaaaauug

SEQ ID NO: 1717 - RNA, 19 nt, artificial
  Chemically synthesized
cauaagcgggacuucauuc

SEQ ID NO: 1718 - RNA, 19 nt, artificial
  Chemically synthesized
aaucaggcuucucugucuu

SEQ ID NO: 1719 - RNA, 19 nt, artificial
  Chemically synthesized
cugcauucccaagacacug

SEQ ID NO: 1720 - RNA, 19 nt, artificial
  Chemically synthesized
uuccguggaauguuuggaa

SEQ ID NO: 1721 - RNA, 19 nt, artificial
  Chemically synthesized
acuugaaaaauucagccug

SEQ ID NO: 1722 - RNA, 19 nt, artificial
  Chemically synthesized
acaauagaggaagauucuu

SEQ ID NO: 1723 - RNA, 19 nt, artificial
  Chemically synthesized
uagaguuugaugacuguac

SEQ ID NO: 1724 - RNA, 19 nt, artificial
  Chemically synthesized
gugucuggcaugugcugug

SEQ ID NO: 1725 - RNA, 19 nt, artificial
  Chemically synthesized
cuaaggagcaacuugacuc

SEQ ID NO: 1726 - RNA, 19 nt, artificial
  Chemically synthesized
cuuugugaagagugagugg

SEQ ID NO: 1727 - RNA, 19 nt, artificial
  Chemically synthesized
aggccaaaaggaagcccag

SEQ ID NO: 1728 - RNA, 19 nt, artificial
  Chemically synthesized
aaauauggacaccuucacu

SEQ ID NO: 1729 - RNA, 19 nt, artificial
  Chemically synthesized
acuuaccuuccuugaggaa

SEQ ID NO: 1730 - RNA, 19 nt, artificial
  Chemically synthesized
agacuuuggaagcuggugg

SEQ ID NO: 1731 - RNA, 19 nt, artificial
  Chemically synthesized
gauuuugcuggacuuaccu

SEQ ID NO: 1732 - RNA, 19 nt, artificial
  Chemically synthesized
gaugacuguacccuuaaug

SEQ ID NO: 1733 - RNA, 19 nt, artificial
  Chemically synthesized
cucuccaucccaugugcgu

SEQ ID NO: 1734 - RNA, 19 nt, artificial
  Chemically synthesized
acagcacuggugucuggca

SEQ ID NO: 1735 - RNA, 19 nt, artificial
  Chemically synthesized
cuaccagaugccucccucu

SEQ ID NO: 1736 - RNA, 19 nt, artificial
  Chemically synthesized
ugcaaguaugaacuggacu

SEQ ID NO: 1737 - RNA, 19 nt, artificial
  Chemically synthesized
aaacugucuuugugcuuuc

SEQ ID NO: 1738 - RNA, 19 nt, artificial
  Chemically synthesized
caucaucagccucuccaag

SEQ ID NO: 1739 - RNA, 19 nt, artificial
  Chemically synthesized
augagaacaaugaugcugc

SEQ ID NO: 1740 - RNA, 19 nt, artificial
  Chemically synthesized
uacugggaaauccuuacaa

SEQ ID NO: 1741 - RNA, 19 nt, artificial
  Chemically synthesized
gauucuuuuucuucccugg

SEQ ID NO: 1742 - RNA, 19 nt, artificial
  Chemically synthesized
ggccaaaaggaagcccagg

SEQ ID NO: 1743 - RNA, 19 nt, artificial
  Chemically synthesized
auguaagucaucugauccu

SEQ ID NO: 1744 - RNA, 19 nt, artificial
  Chemically synthesized
gugacucuccaucccaugu

SEQ ID NO: 1745 - RNA, 19 nt, artificial
  Chemically synthesized
aucagccucuccaaggaag

SEQ ID NO: 1746 - RNA, 19 nt, artificial
  Chemically synthesized
acaggaucaccuacauuag

SEQ ID NO: 1747 - RNA, 19 nt, artificial
  Chemically synthesized
uuggaagcugguggcaaua

SEQ ID NO: 1748 - RNA, 19 nt, artificial
  Chemically synthesized
agaccuaccuggaguggcc

SEQ ID NO: 1749 - RNA, 19 nt, artificial
  Chemically synthesized
gauaaugacagaguuauag

SEQ ID NO: 1750 - RNA, 19 nt, artificial
  Chemically synthesized
guggugcaaguaugaacug

SEQ ID NO: 1751 - RNA, 19 nt, artificial
  Chemically synthesized
uuuacugcuggagauuuuu

SEQ ID NO: 1752 - RNA, 19 nt, artificial
  Chemically synthesized
gaagagugaguggugcaag

SEQ ID NO: 1753 - RNA, 19 nt, artificial
  Chemically synthesized
ucuggauuguuagaauuag

SEQ ID NO: 1754 - RNA, 19 nt, artificial
  Chemically synthesized
guaugaacuggacuucucc

SEQ ID NO: 1755 - RNA, 19 nt, artificial
  Chemically synthesized
acaguagaaaacaguaaag

SEQ ID NO: 1756 - RNA, 19 nt, artificial
  Chemically synthesized
gacucuccaucccaugugc

SEQ ID NO: 1757 - RNA, 19 nt, artificial
  Chemically synthesized
uugaauuugccgcaacuca

SEQ ID NO: 1758 - RNA, 19 nt, artificial
  Chemically synthesized
ucagaacuauccacuggug

SEQ ID NO: 1759 - RNA, 19 nt, artificial
  Chemically synthesized
cuccaaggaagaauccucc

SEQ ID NO: 1760 - RNA, 19 nt, artificial
  Chemically synthesized
accuguccaacaacaggau

SEQ ID NO: 1761 - RNA, 19 nt, artificial
  Chemically synthesized
caccaagaccuaccuggag

SEQ ID NO: 1762 - RNA, 19 nt, artificial
  Chemically synthesized
auuuuggguaaaucugaga

SEQ ID NO: 1763 - RNA, 19 nt, artificial
  Chemically synthesized
aauccggaggcugcauauu

SEQ ID NO: 1764 - RNA, 19 nt, artificial
  Chemically synthesized
guugugucuucauaagcgg

SEQ ID NO: 1765 - RNA, 19 nt, artificial
  Chemically synthesized
guggaauguuuggaacugc

SEQ ID NO: 1766 - RNA, 19 nt, artificial
  Chemically synthesized
aaauuaccugugugacucu

SEQ ID NO: 1767 - RNA, 19 nt, artificial
  Chemically synthesized
gaucuacagagcuaugagc

SEQ ID NO: 1768 - RNA, 19 nt, artificial
  Chemically synthesized
uccaaucaggcuucucugu

SEQ ID NO: 1769 - RNA, 19 nt, artificial
  Chemically synthesized
acaaugaugcugccauucu

SEQ ID NO: 1770 - RNA, 19 nt, artificial
  Chemically synthesized
agcacacgaauacacagug

SEQ ID NO: 1771 - RNA, 19 nt, artificial
  Chemically synthesized
acauuagcaacagugaccu

SEQ ID NO: 1772 - RNA, 19 nt, artificial
  Chemically synthesized
agaauccuccaaucaggcu

SEQ ID NO: 1773 - RNA, 19 nt, artificial
  Chemically synthesized
agcaagcacuggccaaagu

SEQ ID NO: 1774 - RNA, 19 nt, artificial
  Chemically synthesized
uauccagcacacgaauaca

SEQ ID NO: 1775 - RNA, 19 nt, artificial
  Chemically synthesized
aggaucuuuaaacuccauu

SEQ ID NO: 1776 - RNA, 19 nt, artificial
  Chemically synthesized
auugaugcuucagaucuac

SEQ ID NO: 1777 - RNA, 19 nt, artificial
  Chemically synthesized
accuacauuagcaacagug

SEQ ID NO: 1778 - RNA, 19 nt, artificial
  Chemically synthesized
ugaugcuucagaucuacag

SEQ ID NO: 1779 - RNA, 19 nt, artificial
  Chemically synthesized
uaccuuccuugaggaacuu

SEQ ID NO: 1780 - RNA, 19 nt, artificial
  Chemically synthesized
caaagaaaagauuuugcug

SEQ ID NO: 1781 - RNA, 19 nt, artificial
  Chemically synthesized
gcggaagauaaugaacacc

SEQ ID NO: 1782 - RNA, 19 nt, artificial
  Chemically synthesized
aaguuuuucugguuccuug

SEQ ID NO: 1783 - RNA, 19 nt, artificial
  Chemically synthesized
uugaugcuucagaucuaca

SEQ ID NO: 1784 - RNA, 19 nt, artificial
  Chemically synthesized
agaguuaaaagaaucacag

SEQ ID NO: 1785 - RNA, 19 nt, artificial
  Chemically synthesized
cccagcgcuucugcaagcu

SEQ ID NO: 1786 - RNA, 19 nt, artificial
  Chemically synthesized
gcaagggcagcucaggauc

SEQ ID NO: 1787 - RNA, 19 nt, artificial
  Chemically synthesized
uugugcuuucugaaaacuu

SEQ ID NO: 1788 - RNA, 19 nt, artificial
  Chemically synthesized
ugugcugugcucuguuccu

SEQ ID NO: 1789 - RNA, 19 nt, artificial
  Chemically synthesized
uacacaguguaacaggcug

SEQ ID NO: 1790 - RNA, 19 nt, artificial
  Chemically synthesized
aguuugaugacuguacccu

SEQ ID NO: 1791 - RNA, 19 nt, artificial
  Chemically synthesized
uccagcacacgaauacaca

SEQ ID NO: 1792 - RNA, 19 nt, artificial
  Chemically synthesized
uggccagcaaauuaccugu

SEQ ID NO: 1793 - RNA, 19 nt, artificial
  Chemically synthesized
aaaugugaaaaucaccgau

SEQ ID NO: 1794 - RNA, 19 nt, artificial
  Chemically synthesized
aacaacaggaucaccuaca

SEQ ID NO: 1795 - RNA, 19 nt, artificial
  Chemically synthesized
cucuuacccauguuacuag

SEQ ID NO: 1796 - RNA, 19 nt, artificial
  Chemically synthesized
ugguuccuuguuuacuuuc

SEQ ID NO: 1797 - RNA, 19 nt, artificial
  Chemically synthesized
ugagaaaaaagccauuccc

SEQ ID NO: 1798 - RNA, 19 nt, artificial
  Chemically synthesized
caacagugaccuacagagg

SEQ ID NO: 1799 - RNA, 19 nt, artificial
  Chemically synthesized
auaaguugaugacucuacc

SEQ ID NO: 1800 - RNA, 19 nt, artificial
  Chemically synthesized
uucuuacagugagcgggau

SEQ ID NO: 1801 - RNA, 19 nt, artificial
  Chemically synthesized
gaucaccuacauuagcaac

SEQ ID NO: 1802 - RNA, 19 nt, artificial
  Chemically synthesized
cacaaaacugucuuugugc

SEQ ID NO: 1803 - RNA, 19 nt, artificial
  Chemically synthesized
cuugaggaacuugagauug

SEQ ID NO: 1804 - RNA, 19 nt, artificial
  Chemically synthesized
ucuccaaggaagaauccuc

SEQ ID NO: 1805 - RNA, 19 nt, artificial
  Chemically synthesized
aaauucagccugugaggau

SEQ ID NO: 1806 - RNA, 19 nt, artificial
  Chemically synthesized
ugagaacaaugaugcugcc

SEQ ID NO: 1807 - RNA, 19 nt, artificial
  Chemically synthesized
ucugagagcugcgauaaag

SEQ ID NO: 1808 - RNA, 19 nt, artificial
  Chemically synthesized
caucucuuuuuucucaucu

SEQ ID NO: 1809 - RNA, 19 nt, artificial
  Chemically synthesized
gaaauauggacaccuucac

SEQ ID NO: 1810 - RNA, 19 nt, artificial
  Chemically synthesized
cuuuaaacuccauucccuc

SEQ ID NO: 1811 - RNA, 19 nt, artificial
  Chemically synthesized
uucuuugaauuugccgcaa

SEQ ID NO: 1812 - RNA, 19 nt, artificial
  Chemically synthesized
uucuucuggagcccauuga

SEQ ID NO: 1813 - RNA, 19 nt, artificial
  Chemically synthesized
uggguaaaucugagagcug

SEQ ID NO: 1814 - RNA, 19 nt, artificial
  Chemically synthesized
ccacuggugaaacaaauuc

SEQ ID NO: 1815 - RNA, 19 nt, artificial
  Chemically synthesized
cgggaugccuacugggugg

SEQ ID NO: 1816 - RNA, 19 nt, artificial
  Chemically synthesized
cuggagauuuuuguagaug

SEQ ID NO: 1817 - RNA, 19 nt, artificial
  Chemically synthesized
ugaagcagcauauuuuacu

SEQ ID NO: 1818 - RNA, 19 nt, artificial
  Chemically synthesized
auuugccgcaacucaaaga

SEQ ID NO: 1819 - RNA, 19 nt, artificial
  Chemically synthesized
gaaccuuaugguccaggag

SEQ ID NO: 1820 - RNA, 19 nt, artificial
  Chemically synthesized
augaacuggacuucuccca

SEQ ID NO: 1821 - RNA, 19 nt, artificial
  Chemically synthesized
uucucccauuuccgucuuu

SEQ ID NO: 1822 - RNA, 19 nt, artificial
  Chemically synthesized
aacagugaccuacagaggu

SEQ ID NO: 1823 - RNA, 19 nt, artificial
  Chemically synthesized
uucagaacuauccacuggu

SEQ ID NO: 1824 - RNA, 19 nt, artificial
  Chemically synthesized
aauaaguugaugacucuac

SEQ ID NO: 1825 - RNA, 19 nt, artificial
  Chemically synthesized
gucuggcaugugcugugcu

SEQ ID NO: 1826 - RNA, 19 nt, artificial
  Chemically synthesized
ugcuucagaucuacagagc

SEQ ID NO: 1827 - RNA, 19 nt, artificial
  Chemically synthesized
ucauuccuggcaaguggau

SEQ ID NO: 1828 - RNA, 19 nt, artificial
  Chemically synthesized
aagggcagcucaggaucuu

SEQ ID NO: 1829 - RNA, 19 nt, artificial
  Chemically synthesized
cuaugccugaaacuuguca

SEQ ID NO: 1830 - RNA, 19 nt, artificial
  Chemically synthesized
ucagaauguaagucaucug

SEQ ID NO: 1831 - RNA, 19 nt, artificial
  Chemically synthesized
gaucuuuaaacuccauucc

SEQ ID NO: 1832 - RNA, 19 nt, artificial
  Chemically synthesized
uccggaggcugcauauucc

SEQ ID NO: 1833 - RNA, 19 nt, artificial
  Chemically synthesized
aauacacaguguaacaggc

SEQ ID NO: 1834 - RNA, 19 nt, artificial
  Chemically synthesized
augccuggcccucucuaca

SEQ ID NO: 1835 - RNA, 19 nt, artificial
  Chemically synthesized
ucagaucuacagagcuaug

SEQ ID NO: 1836 - RNA, 19 nt, artificial
  Chemically synthesized
uuugccgcaacucaaagaa

SEQ ID NO: 1837 - RNA, 19 nt, artificial
  Chemically synthesized
uggacuuaccuuccuugag

SEQ ID NO: 1838 - RNA, 19 nt, artificial
  Chemically synthesized
accuggaguggcccaugga

SEQ ID NO: 1839 - RNA, 19 nt, artificial
  Chemically synthesized
auacacaguguaacaggcu

SEQ ID NO: 1840 - RNA, 19 nt, artificial
  Chemically synthesized
acuucauuccuggcaagug

SEQ ID NO: 1841 - RNA, 19 nt, artificial
  Chemically synthesized
auucuuaaacuuacuggga

SEQ ID NO: 1842 - RNA, 19 nt, artificial
  Chemically synthesized
ugagccaaaaaguuugaag

SEQ ID NO: 1843 - RNA, 19 nt, artificial
  Chemically synthesized
gcuuucugaaaacuuugug

SEQ ID NO: 1844 - RNA, 19 nt, artificial
  Chemically synthesized
gcgggacuucauuccuggc

SEQ ID NO: 1845 - RNA, 19 nt, artificial
  Chemically synthesized
acaucucuuuuuucucauc

SEQ ID NO: 1846 - RNA, 19 nt, artificial
  Chemically synthesized
uuuuucugguuccuuguuu

SEQ ID NO: 1847 - RNA, 19 nt, artificial
  Chemically synthesized
ggaagcccaggaaagcucc

SEQ ID NO: 1848 - RNA, 19 nt, artificial
  Chemically synthesized
uaccugugugacucuccau

SEQ ID NO: 1849 - RNA, 19 nt, artificial
  Chemically synthesized
acaguaaaguuuuucuggu

SEQ ID NO: 1850 - RNA, 19 nt, artificial
  Chemically synthesized
augagccaaaaaguuugaa

SEQ ID NO: 1851 - RNA, 19 nt, artificial
  Chemically synthesized
ugaacauuuagacuuaucc

SEQ ID NO: 1852 - RNA, 19 nt, artificial
  Chemically synthesized
uugaaaagagccacaaaac

SEQ ID NO: 1853 - RNA, 19 nt, artificial
  Chemically synthesized
auucagaauguaagucauc

SEQ ID NO: 1854 - RNA, 19 nt, artificial
  Chemically synthesized
caucccaugugcguggcca

SEQ ID NO: 1855 - RNA, 19 nt, artificial
  Chemically synthesized
aagcugguggcaauaacuu

SEQ ID NO: 1856 - RNA, 19 nt, artificial
  Chemically synthesized
uggaauguuuggaacugcg

SEQ ID NO: 1857 - RNA, 19 nt, artificial
  Chemically synthesized
guucaggauguccgccucu

SEQ ID NO: 1858 - RNA, 19 nt, artificial
  Chemically synthesized
gacacuuuccauuuuucag

SEQ ID NO: 1859 - RNA, 19 nt, artificial
  Chemically synthesized
uccauuuuucagaacuauc

SEQ ID NO: 1860 - RNA, 19 nt, artificial
  Chemically synthesized
ucucccauuuccgucuuuu

SEQ ID NO: 1861 - RNA, 19 nt, artificial
  Chemically synthesized
cuugagauugaugcuucag

SEQ ID NO: 1862 - RNA, 19 nt, artificial
  Chemically synthesized
ugauuggccagcaaauuac

SEQ ID NO: 1863 - RNA, 19 nt, artificial
  Chemically synthesized
ucuuuuucuucccugggca

SEQ ID NO: 1864 - RNA, 19 nt, artificial
  Chemically synthesized
gaaauccuuacaaaacccu

SEQ ID NO: 1865 - RNA, 19 nt, artificial
  Chemically synthesized
ucaucugauccuucauaug

SEQ ID NO: 1866 - RNA, 19 nt, artificial
  Chemically synthesized
ugugugacucuccauccca

SEQ ID NO: 1867 - RNA, 19 nt, artificial
  Chemically synthesized
guuucuuacagugagcggg

SEQ ID NO: 1868 - RNA, 19 nt, artificial
  Chemically synthesized
ucuuacccauguuacuagu

SEQ ID NO: 1869 - RNA, 19 nt, artificial
  Chemically synthesized
uuccgucuuuuugaugaga

SEQ ID NO: 1870 - RNA, 19 nt, artificial
  Chemically synthesized
augacagaguuauagaucc

SEQ ID NO: 1871 - RNA, 19 nt, artificial
  Chemically synthesized
gcauauuuuacugcuggag

SEQ ID NO: 1872 - RNA, 19 nt, artificial
  Chemically synthesized
cuggacuucucccauuucc

SEQ ID NO: 1873 - RNA, 19 nt, artificial
  Chemically synthesized
aauucagccugugaggaug

SEQ ID NO: 1874 - RNA, 19 nt, artificial
  Chemically synthesized
auccggaggcugcauauuc

SEQ ID NO: 1875 - RNA, 19 nt, artificial
  Chemically synthesized
guggauggugugggucuug

SEQ ID NO: 1876 - RNA, 19 nt, artificial
  Chemically synthesized
ugucuucauaagcgggacu

SEQ ID NO: 1877 - RNA, 19 nt, artificial
  Chemically synthesized
ccuaccuggaguggcccau

SEQ ID NO: 1878 - RNA, 19 nt, artificial
  Chemically synthesized
uugaaaaucaguaggaaug

SEQ ID NO: 1879 - RNA, 19 nt, artificial
  Chemically synthesized
caacaacaggaucaccuac

SEQ ID NO: 1880 - RNA, 19 nt, artificial
  Chemically synthesized
agccacaaaacugucuuug

SEQ ID NO: 1881 - RNA, 19 nt, artificial
  Chemically synthesized
uugacaauaucauugacuc

SEQ ID NO: 1882 - RNA, 19 nt, artificial
  Chemically synthesized
accgaugaaaguuuguuuc

SEQ ID NO: 1883 - RNA, 19 nt, artificial
  Chemically synthesized
cacuggugucuggcaugug

SEQ ID NO: 1884 - RNA, 19 nt, artificial
  Chemically synthesized
cauuccuggcaaguggauc

SEQ ID NO: 1885 - RNA, 19 nt, artificial
  Chemically synthesized
uacugcuggagauuuuugu

SEQ ID NO: 1886 - RNA, 19 nt, artificial
  Chemically synthesized
ugccacauacuuuguggau

SEQ ID NO: 1887 - RNA, 19 nt, artificial
  Chemically synthesized
cucuuuuuucucaucucac

SEQ ID NO: 1888 - RNA, 19 nt, artificial
  Chemically synthesized
ccucuccaaggaagaaucc

SEQ ID NO: 1889 - RNA, 19 nt, artificial
  Chemically synthesized
uucugcaagcugcggaaga

SEQ ID NO: 1890 - RNA, 19 nt, artificial
  Chemically synthesized
ucuaaggagcaacuugacu

SEQ ID NO: 1891 - RNA, 19 nt, artificial
  Chemically synthesized
cccaugugcguggccagca

SEQ ID NO: 1892 - RNA, 19 nt, artificial
  Chemically synthesized
ggccagcaaauuaccugug

SEQ ID NO: 1893 - RNA, 19 nt, artificial
  Chemically synthesized
ugugucuucauaagcggga

SEQ ID NO: 1894 - RNA, 19 nt, artificial
  Chemically synthesized
uuggguaaaucugagagcu

SEQ ID NO: 1895 - RNA, 19 nt, artificial
  Chemically synthesized
agcaaauuaccugugugac

SEQ ID NO: 1896 - RNA, 19 nt, artificial
  Chemically synthesized
uuucuuacagugagcggga

SEQ ID NO: 1897 - RNA, 19 nt, artificial
  Chemically synthesized
gacuucucccauuuccguc

SEQ ID NO: 1898 - RNA, 19 nt, artificial
  Chemically synthesized
aaggaagcccaggaaagcu

SEQ ID NO: 1899 - RNA, 19 nt, artificial
  Chemically synthesized
guacccuuaauggaguugg

SEQ ID NO: 1900 - RNA, 19 nt, artificial
  Chemically synthesized
agaaaugugaaaaucaccg

SEQ ID NO: 1901 - RNA, 19 nt, artificial
  Chemically synthesized
gaagauucuuuuucuuccc

SEQ ID NO: 1902 - RNA, 19 nt, artificial
  Chemically synthesized
cuccauugaaaagagccac

SEQ ID NO: 1903 - RNA, 19 nt, artificial
  Chemically synthesized
cauucuuaaacuuacuggg

SEQ ID NO: 1904 - RNA, 19 nt, artificial
  Chemically synthesized
augcuucagaucuacagag

SEQ ID NO: 1905 - RNA, 19 nt, artificial
  Chemically synthesized
uauggacaccuucacuaag

SEQ ID NO: 1906 - RNA, 19 nt, artificial
  Chemically synthesized
uguuccugcugauccugcu

SEQ ID NO: 1907 - RNA, 19 nt, artificial
  Chemically synthesized
gcgggaugccuacugggug

SEQ ID NO: 1908 - RNA, 19 nt, artificial
  Chemically synthesized
auacuuuguggauggugug

SEQ ID NO: 1909 - RNA, 19 nt, artificial
  Chemically synthesized
auuuugcuggacuuaccuu

SEQ ID NO: 1910 - RNA, 19 nt, artificial
  Chemically synthesized
uuucuuugaauuugccgca

SEQ ID NO: 1911 - RNA, 19 nt, artificial
  Chemically synthesized
aggaacuugagauugaugc

SEQ ID NO: 1912 - RNA, 19 nt, artificial
  Chemically synthesized
aucucuuuuuucucaucuc

SEQ ID NO: 1913 - RNA, 19 nt, artificial
  Chemically synthesized
ugcauucccaagacacugg

SEQ ID NO: 1914 - RNA, 19 nt, artificial
  Chemically synthesized
cugcgagauacugauuugg

SEQ ID NO: 1915 - RNA, 19 nt, artificial
  Chemically synthesized
caauaacuucauuugcucc

SEQ ID NO: 1916 - RNA, 19 nt, artificial
  Chemically synthesized
augccacauacuuugugga

SEQ ID NO: 1917 - RNA, 19 nt, artificial
  Chemically synthesized
agcgggaugccuacugggu

SEQ ID NO: 1918 - RNA, 19 nt, artificial
  Chemically synthesized
uagcaacagugaccuacag

SEQ ID NO: 1919 - RNA, 19 nt, artificial
  Chemically synthesized
uuuguuucuuacagugagc

SEQ ID NO: 1920 - RNA, 19 nt, artificial
  Chemically synthesized
uucugaaaacuuugugaag

SEQ ID NO: 1921 - RNA, 19 nt, artificial
  Chemically synthesized
aaguuugaagucaauucag

SEQ ID NO: 1922 - RNA, 19 nt, artificial
  Chemically synthesized
uaacaauccggaggcugca

SEQ ID NO: 1923 - RNA, 19 nt, artificial
  Chemically synthesized
uccugugccaccguuucca

SEQ ID NO: 1924 - RNA, 19 nt, artificial
  Chemically synthesized
cugcuggagauuuuuguag

SEQ ID NO: 1925 - RNA, 19 nt, artificial
  Chemically synthesized
agguucaggauguccgccu

SEQ ID NO: 1926 - RNA, 19 nt, artificial
  Chemically synthesized
uuaugguccaggagcugga

SEQ ID NO: 1927 - RNA, 19 nt, artificial
  Chemically synthesized
gacagaguuauagauccag

SEQ ID NO: 1928 - RNA, 19 nt, artificial
  Chemically synthesized
gaugccuggcccucucuac

SEQ ID NO: 1929 - RNA, 19 nt, artificial
  Chemically synthesized
gugcugugcucuguuccug

SEQ ID NO: 1930 - RNA, 19 nt, artificial
  Chemically synthesized
uggacuucucccauuuccg

SEQ ID NO: 1931 - RNA, 19 nt, artificial
  Chemically synthesized
uggcuccaggccaaaagga

SEQ ID NO: 1932 - RNA, 19 nt, artificial
  Chemically synthesized
aucaccgaugaaaguuugu

SEQ ID NO: 1933 - RNA, 19 nt, artificial
  Chemically synthesized
uggauuguuagaauuagag

SEQ ID NO: 1934 - RNA, 19 nt, artificial
  Chemically synthesized
uggguggagaaccuuaugg

SEQ ID NO: 1935 - RNA, 19 nt, artificial
  Chemically synthesized
uucuaaggagcaacuugac

SEQ ID NO: 1936 - RNA, 19 nt, artificial
  Chemically synthesized
auugagaaaaaagccauuc

SEQ ID NO: 1937 - RNA, 19 nt, artificial
  Chemically synthesized
gacuuuggaagcugguggc

SEQ ID NO: 1938 - RNA, 19 nt, artificial
  Chemically synthesized
uuaccugugugacucucca

SEQ ID NO: 1939 - RNA, 19 nt, artificial
  Chemically synthesized
gaaacaucucuuuuuucuc

SEQ ID NO: 1940 - RNA, 19 nt, artificial
  Chemically synthesized
uuugaacuuauccagcaca

SEQ ID NO: 1941 - RNA, 19 nt, artificial
  Chemically synthesized
ugccuacuggguggagaac

SEQ ID NO: 1942 - RNA, 19 nt, artificial
  Chemically synthesized
auuugaacuuauccagcac

SEQ ID NO: 1943 - RNA, 19 nt, artificial
  Chemically synthesized
uuacaaguuccguggaaug

SEQ ID NO: 1944 - RNA, 19 nt, artificial
  Chemically synthesized
ucaggcuucucugucuugu

SEQ ID NO: 1945 - RNA, 19 nt, artificial
  Chemically synthesized
agcgcuucugcaagcugcg

SEQ ID NO: 1946 - RNA, 19 nt, artificial
  Chemically synthesized
uaacuucauuugcuccugu

SEQ ID NO: 1947 - RNA, 19 nt, artificial
  Chemically synthesized
aauccuccaaucaggcuuc

SEQ ID NO: 1948 - RNA, 19 nt, artificial
  Chemically synthesized
acacaguguaacaggcugc

SEQ ID NO: 1949 - RNA, 19 nt, artificial
  Chemically synthesized
gagagcugcgauaaagucc

SEQ ID NO: 1950 - RNA, 19 nt, artificial
  Chemically synthesized
auugacuccauugaaaaga

SEQ ID NO: 1951 - RNA, 19 nt, artificial
  Chemically synthesized
ccuuaugguccaggagcug

SEQ ID NO: 1952 - RNA, 19 nt, artificial
  Chemically synthesized
cagcgcuucugcaagcugc

SEQ ID NO: 1953 - RNA, 19 nt, artificial
  Chemically synthesized
acuggacuucucccauuuc

SEQ ID NO: 1954 - RNA, 19 nt, artificial
  Chemically synthesized
guguaacaggcugcauucc

SEQ ID NO: 1955 - RNA, 19 nt, artificial
  Chemically synthesized
uuugcuccugugaauuccu

SEQ ID NO: 1956 - RNA, 19 nt, artificial
  Chemically synthesized
aguuccguggaauguuugg

SEQ ID NO: 1957 - RNA, 19 nt, artificial
  Chemically synthesized
cagccugugaggaugccug

SEQ ID NO: 1958 - RNA, 19 nt, artificial
  Chemically synthesized
ucuucuggagcccauugag

SEQ ID NO: 1959 - RNA, 19 nt, artificial
  Chemically synthesized
uuguggauggugugggucu

SEQ ID NO: 1960 - RNA, 19 nt, artificial
  Chemically synthesized
aaaaauucagccugugagg

SEQ ID NO: 1961 - RNA, 19 nt, artificial
  Chemically synthesized
uggcaauaacuucauuugc

SEQ ID NO: 1962 - RNA, 19 nt, artificial
  Chemically synthesized
uggugucuggcaugugcug

SEQ ID NO: 1963 - RNA, 19 nt, artificial
  Chemically synthesized
cagcauauuuuacugcugg

SEQ ID NO: 1964 - RNA, 19 nt, artificial
  Chemically synthesized
uugucaguggccagaaaag

SEQ ID NO: 1965 - RNA, 19 nt, artificial
  Chemically synthesized
uuuaaacuccauucccuca

SEQ ID NO: 1966 - RNA, 19 nt, artificial
  Chemically synthesized
ccugugugacucuccaucc

SEQ ID NO: 1967 - RNA, 19 nt, artificial
  Chemically synthesized
gagcagcaagcacuggcca

SEQ ID NO: 1968 - RNA, 19 nt, artificial
  Chemically synthesized
aggaagcccaggaaagcuc

SEQ ID NO: 1969 - RNA, 19 nt, artificial
  Chemically synthesized
gacuccauugaaaagagcc

SEQ ID NO: 1970 - RNA, 19 nt, artificial
  Chemically synthesized
uuccuugaggaacuugaga

SEQ ID NO: 1971 - RNA, 19 nt, artificial
  Chemically synthesized
uacaaguuccguggaaugu

SEQ ID NO: 1972 - RNA, 19 nt, artificial
  Chemically synthesized
aaaaucaccgaugaaaguu

SEQ ID NO: 1973 - RNA, 19 nt, artificial
  Chemically synthesized
ugacaauaucauugacucc

SEQ ID NO: 1974 - RNA, 19 nt, artificial
  Chemically synthesized
gaacaccaagaccuaccug

SEQ ID NO: 1975 - RNA, 19 nt, artificial
  Chemically synthesized
ucuuugaauuugccgcaac

SEQ ID NO: 1976 - RNA, 19 nt, artificial
  Chemically synthesized
ucaccgaugaaaguuuguu

SEQ ID NO: 1977 - RNA, 19 nt, artificial
  Chemically synthesized
ugagagcugcgauaaaguc

SEQ ID NO: 1978 - RNA, 19 nt, artificial
  Chemically synthesized
uggcaugugcugugcucug

SEQ ID NO: 1979 - RNA, 19 nt, artificial
  Chemically synthesized
acuggugucuggcaugugc

SEQ ID NO: 1980 - RNA, 19 nt, artificial
  Chemically synthesized
ucuucauaagcgggacuuc

SEQ ID NO: 1981 - RNA, 19 nt, artificial
  Chemically synthesized
auucuucuggagcccauug

SEQ ID NO: 1982 - RNA, 19 nt, artificial
  Chemically synthesized
aaaauucagccugugagga

SEQ ID NO: 1983 - RNA, 19 nt, artificial
  Chemically synthesized
ucaccuacauuagcaacag

SEQ ID NO: 1984 - RNA, 19 nt, artificial
  Chemically synthesized
ccuggaguggcccauggac

SEQ ID NO: 1985 - RNA, 19 nt, artificial
  Chemically synthesized
uccguggaauguuuggaac

SEQ ID NO: 1986 - RNA, 19 nt, artificial
  Chemically synthesized
accuaccuggaguggccca

SEQ ID NO: 1987 - RNA, 19 nt, artificial
  Chemically synthesized
uuuucuaaggagcaacuug

SEQ ID NO: 1988 - RNA, 19 nt, artificial
  Chemically synthesized
aaacuuugugaagagugag

SEQ ID NO: 1989 - RNA, 19 nt, artificial
  Chemically synthesized
auccuccaaucaggcuucu

SEQ ID NO: 1990 - RNA, 19 nt, artificial
  Chemically synthesized
uacuugaaaaauucagccu

SEQ ID NO: 1991 - RNA, 19 nt, artificial
  Chemically synthesized
uggugcaaguaugaacugg

SEQ ID NO: 1992 - RNA, 19 nt, artificial
  Chemically synthesized
aagcgggacuucauuccug

SEQ ID NO: 1993 - RNA, 19 nt, artificial
  Chemically synthesized
uagaaaugugaaaaucacc

SEQ ID NO: 1994 - RNA, 19 nt, artificial
  Chemically synthesized
uugaagucaauucagaaug

SEQ ID NO: 1995 - RNA, 19 nt, artificial
  Chemically synthesized
ucugaaaaacuugacuaac

SEQ ID NO: 1996 - RNA, 19 nt, artificial
  Chemically synthesized
aaugaacaccaagaccuac

SEQ ID NO: 1997 - RNA, 19 nt, artificial
  Chemically synthesized
gauuggccagcaaauuacc

SEQ ID NO: 1998 - RNA, 19 nt, artificial
  Chemically synthesized
acuuuccauuuuucagaac

SEQ ID NO: 1999 - RNA, 19 nt, artificial
  Chemically synthesized
acagaguuauagauccagg

SEQ ID NO: 2000 - RNA, 19 nt, artificial
  Chemically synthesized
ccaaucaggcuucucuguc

SEQ ID NO: 2001 - RNA, 19 nt, artificial
  Chemically synthesized
augguccaggagcuggaga

SEQ ID NO: 2002 - RNA, 19 nt, artificial
  Chemically synthesized
uucugguuccuuguuuacu

SEQ ID NO: 2003 - RNA, 19 nt, artificial
  Chemically synthesized
uggcaaguggaucauugac

SEQ ID NO: 2004 - RNA, 19 nt, artificial
  Chemically synthesized
auuagaauacuuggaucuc

SEQ ID NO: 2005 - RNA, 19 nt, artificial
  Chemically synthesized
cuuacagugagcgggaugc

SEQ ID NO: 2006 - RNA, 19 nt, artificial
  Chemically synthesized
uugugaagagugaguggug

SEQ ID NO: 2007 - RNA, 19 nt, artificial
  Chemically synthesized
aagagccacaaaacugucu

SEQ ID NO: 2008 - RNA, 19 nt, artificial
  Chemically synthesized
cuggcuccaggccaaaagg

SEQ ID NO: 2009 - RNA, 19 nt, artificial
  Chemically synthesized
cuccuucacucaggagcag

SEQ ID NO: 2010 - RNA, 19 nt, artificial
  Chemically synthesized
uugaugagaacaaugaugc

SEQ ID NO: 2011 - RNA, 19 nt, artificial
  Chemically synthesized
gcucuguuccugcugaucc

SEQ ID NO: 2012 - RNA, 19 nt, artificial
  Chemically synthesized
ugaugugggccuggcucca

SEQ ID NO: 2013 - RNA, 19 nt, artificial
  Chemically synthesized
ccuggcuccaggccaaaag

SEQ ID NO: 2014 - RNA, 19 nt, artificial
  Chemically synthesized
gaugacucuaccagaugcc

SEQ ID NO: 2015 - RNA, 19 nt, artificial
  Chemically synthesized
acuuugugaagagugagug

SEQ ID NO: 2016 - RNA, 19 nt, artificial
  Chemically synthesized
aagacacuggaaauuuuag

SEQ ID NO: 2017 - RNA, 19 nt, artificial
  Chemically synthesized
guccugugccaccguuucc

SEQ ID NO: 2018 - RNA, 19 nt, artificial
  Chemically synthesized
cagcucaggaucuuuaaac

SEQ ID NO: 2019 - RNA, 19 nt, artificial
  Chemically synthesized
auuugcuccugugaauucc

SEQ ID NO: 2020 - RNA, 19 nt, artificial
  Chemically synthesized
uuugugcuuucugaaaacu

SEQ ID NO: 2021 - RNA, 19 nt, artificial
  Chemically synthesized
aacaauccggaggcugcau

SEQ ID NO: 2022 - RNA, 19 nt, artificial
  Chemically synthesized
uaaaucugagagcugcgau

SEQ ID NO: 2023 - RNA, 19 nt, artificial
  Chemically synthesized
aucaucagccucuccaagg

SEQ ID NO: 2024 - RNA, 19 nt, artificial
  Chemically synthesized
uugagaaaaaagccauucc

SEQ ID NO: 2025 - RNA, 19 nt, artificial
  Chemically synthesized
agauucuuuuucuucccug

SEQ ID NO: 2026 - RNA, 19 nt, artificial
  Chemically synthesized
auaacuucauuugcuccug

SEQ ID NO: 2027 - RNA, 19 nt, artificial
  Chemically synthesized
cucuaccagaugccucccu

SEQ ID NO: 2028 - RNA, 19 nt, artificial
  Chemically synthesized
aagacuuuggaagcuggug

SEQ ID NO: 2029 - RNA, 19 nt, artificial
  Chemically synthesized
cucaggaucuuuaaacucc

SEQ ID NO: 2030 - RNA, 19 nt, artificial
  Chemically synthesized
acuuuggaagcugguggca

SEQ ID NO: 2031 - RNA, 19 nt, artificial
  Chemically synthesized
aaaggaagcccaggaaagc

SEQ ID NO: 2032 - RNA, 19 nt, artificial
  Chemically synthesized
aaguuccguggaauguuug

SEQ ID NO: 2033 - RNA, 19 nt, artificial
  Chemically synthesized
aaaguuuuucugguuccuu

SEQ ID NO: 2034 - RNA, 19 nt, artificial
  Chemically synthesized
ucccauuuccgucuuuuug

SEQ ID NO: 2035 - RNA, 19 nt, artificial
  Chemically synthesized
cagcaagcacuggccaaag

SEQ ID NO: 2036 - RNA, 19 nt, artificial
  Chemically synthesized
agugagcgggaugccuacu

SEQ ID NO: 2037 - RNA, 19 nt, artificial
  Chemically synthesized
aacuucauuugcuccugug

SEQ ID NO: 2038 - RNA, 19 nt, artificial
  Chemically synthesized
uugaugacucuaccagaug

SEQ ID NO: 2039 - RNA, 19 nt, artificial
  Chemically synthesized
ucuuacagugagcgggaug

SEQ ID NO: 2040 - RNA, 19 nt, artificial
  Chemically synthesized
cuuaccuuccuugaggaac

SEQ ID NO: 2041 - RNA, 19 nt, artificial
  Chemically synthesized
cuaccuggaguggcccaug

SEQ ID NO: 2042 - RNA, 19 nt, artificial
  Chemically synthesized
uuacugggaaauccuuaca

SEQ ID NO: 2043 - RNA, 19 nt, artificial
  Chemically synthesized
augacucuaccagaugccu

SEQ ID NO: 2044 - RNA, 19 nt, artificial
  Chemically synthesized
aucaggcuucucugucuug

SEQ ID NO: 2045 - RNA, 19 nt, artificial
  Chemically synthesized
uaagcgggacuucauuccu

SEQ ID NO: 2046 - RNA, 19 nt, artificial
  Chemically synthesized
ccagcgcuucugcaagcug

SEQ ID NO: 2047 - RNA, 19 nt, artificial
  Chemically synthesized
uacauuagcaacagugacc

SEQ ID NO: 2048 - RNA, 19 nt, artificial
  Chemically synthesized
aggaagauucuuuuucuuc

SEQ ID NO: 2049 - RNA, 19 nt, artificial
  Chemically synthesized
uugaaaaauucagccugug

SEQ ID NO: 2050 - RNA, 19 nt, artificial
  Chemically synthesized
ugugaagagugaguggugc

SEQ ID NO: 2051 - RNA, 19 nt, artificial
  Chemically synthesized
aacaggcugcauucccaag

SEQ ID NO: 2052 - RNA, 19 nt, artificial
  Chemically synthesized
aacuauccacuggugaaac

SEQ ID NO: 2053 - RNA, 19 nt, artificial
  Chemically synthesized
aagauuuugcuggacuuac

SEQ ID NO: 2054 - RNA, 19 nt, artificial
  Chemically synthesized
auccuucauaugaagcagc

SEQ ID NO: 2055 - RNA, 19 nt, artificial
  Chemically synthesized
cuucugcaagcugcggaag

SEQ ID NO: 2056 - RNA, 19 nt, artificial
  Chemically synthesized
cuccaggccaaaaggaagc

SEQ ID NO: 2057 - RNA, 19 nt, artificial
  Chemically synthesized
ugaacuuauccagcacacg

SEQ ID NO: 2058 - RNA, 19 nt, artificial
  Chemically synthesized
uaccagaugccucccucuu

SEQ ID NO: 2059 - RNA, 19 nt, artificial
  Chemically synthesized
aauaucauugacuccauug

SEQ ID NO: 2060 - RNA, 19 nt, artificial
  Chemically synthesized
ugacucuaccagaugccuc

SEQ ID NO: 2061 - RNA, 19 nt, artificial
  Chemically synthesized
aagccuugaccuguccaac

SEQ ID NO: 2062 - RNA, 19 nt, artificial
  Chemically synthesized
ggagcagcaagcacuggcc

SEQ ID NO: 2063 - RNA, 19 nt, artificial
  Chemically synthesized
cauuuccgucuuuuugaug

SEQ ID NO: 2064 - RNA, 19 nt, artificial
  Chemically synthesized
ucucaucucacaaaauugc

SEQ ID NO: 2065 - RNA, 19 nt, artificial
  Chemically synthesized
aacaccaagaccuaccugg

SEQ ID NO: 2066 - RNA, 19 nt, artificial
  Chemically synthesized
guaaaguuuuucugguucc

SEQ ID NO: 2067 - RNA, 19 nt, artificial
  Chemically synthesized
accugugugacucuccauc

SEQ ID NO: 2068 - RNA, 19 nt, artificial
  Chemically synthesized
cuccaucccaugugcgugg

SEQ ID NO: 2069 - RNA, 19 nt, artificial
  Chemically synthesized
augacuguacccuuaaugg

SEQ ID NO: 2070 - RNA, 19 nt, artificial
  Chemically synthesized
auuuuucagaacuauccac

SEQ ID NO: 2071 - RNA, 19 nt, artificial
  Chemically synthesized
gcucaggaucuuuaaacuc

SEQ ID NO: 2072 - RNA, 19 nt, artificial
  Chemically synthesized
aaguugugucuucauaagc

SEQ ID NO: 2073 - RNA, 19 nt, artificial
  Chemically synthesized
aaguugaugacucuaccag

SEQ ID NO: 2074 - RNA, 19 nt, artificial
  Chemically synthesized
uauagauccagguaaagug

SEQ ID NO: 2075 - RNA, 19 nt, artificial
  Chemically synthesized
agcccaggaaagcucccag

SEQ ID NO: 2076 - RNA, 19 nt, artificial
  Chemically synthesized
aaagagccacaaaacuguc

SEQ ID NO: 2077 - RNA, 19 nt, artificial
  Chemically synthesized
uguccaacaacaggaucac

SEQ ID NO: 2078 - RNA, 19 nt, artificial
  Chemically synthesized
augaacaccaagaccuacc

SEQ ID NO: 2079 - RNA, 19 nt, artificial
  Chemically synthesized
uugacuccauugaaaagag

SEQ ID NO: 2080 - RNA, 19 nt, artificial
  Chemically synthesized
agaaaagauuuugcuggac

SEQ ID NO: 2081 - RNA, 19 nt, artificial
  Chemically synthesized
ucuggcaugugcugugcuc

SEQ ID NO: 2082 - RNA, 19 nt, artificial
  Chemically synthesized
ugugacucuccaucccaug

SEQ ID NO: 2083 - RNA, 19 nt, artificial
  Chemically synthesized
cugugugacucuccauccc

SEQ ID NO: 2084 - RNA, 19 nt, artificial
  Chemically synthesized
caggaucaccuacauuagc

SEQ ID NO: 2085 - RNA, 19 nt, artificial
  Chemically synthesized
uguacccuuaauggaguug

SEQ ID NO: 2086 - RNA, 19 nt, artificial
  Chemically synthesized
uuccuggcaaguggaucau

SEQ ID NO: 2087 - RNA, 19 nt, artificial
  Chemically synthesized
gcaagcacuggccaaaguc

SEQ ID NO: 2088 - RNA, 19 nt, artificial
  Chemically synthesized
agccugugaggaugccugg

SEQ ID NO: 2089 - RNA, 19 nt, artificial
  Chemically synthesized
ugcucuguuccugcugauc

SEQ ID NO: 2090 - RNA, 19 nt, artificial
  Chemically synthesized
uugcuggacuuaccuuccu

SEQ ID NO: 2091 - RNA, 19 nt, artificial
  Chemically synthesized
uuaacaauccggaggcugc

SEQ ID NO: 2092 - RNA, 19 nt, artificial
  Chemically synthesized
uuucagaacuauccacugg

SEQ ID NO: 2093 - RNA, 19 nt, artificial
  Chemically synthesized
uuucugguuccuuguuuac

SEQ ID NO: 2094 - RNA, 19 nt, artificial
  Chemically synthesized
uuugugaagagugaguggu

SEQ ID NO: 2095 - RNA, 19 nt, artificial
  Chemically synthesized
ccuguccaacaacaggauc

SEQ ID NO: 2096 - RNA, 19 nt, artificial
  Chemically synthesized
uguuucuuacagugagcgg

SEQ ID NO: 2097 - RNA, 19 nt, artificial
  Chemically synthesized
augaagcagcauauuuuac

SEQ ID NO: 2098 - RNA, 19 nt, artificial
  Chemically synthesized
guccaacaacaggaucacc

SEQ ID NO: 2099 - RNA, 19 nt, artificial
  Chemically synthesized
uggugcugacauccaaugg

SEQ ID NO: 2100 - RNA, 19 nt, artificial
  Chemically synthesized
acugucuuugugcuuucug

SEQ ID NO: 2101 - RNA, 19 nt, artificial
  Chemically synthesized
aaaagccuugaccugucca

SEQ ID NO: 2102 - RNA, 19 nt, artificial
  Chemically synthesized
aauguaagucaucugaucc

SEQ ID NO: 2103 - RNA, 19 nt, artificial
  Chemically synthesized
cuuuuucuucccugggcag

SEQ ID NO: 2104 - RNA, 19 nt, artificial
  Chemically synthesized
uccaacaacaggaucaccu

SEQ ID NO: 2105 - RNA, 19 nt, artificial
  Chemically synthesized
auuagcaacagugaccuac

SEQ ID NO: 2106 - RNA, 19 nt, artificial
  Chemically synthesized
ucaggauguccgccucucg

SEQ ID NO: 2107 - RNA, 19 nt, artificial
  Chemically synthesized
uaacacaauagaggaagau

SEQ ID NO: 2108 - RNA, 19 nt, artificial
  Chemically synthesized
guuauagauccagguaaag

SEQ ID NO: 2109 - RNA, 19 nt, artificial
  Chemically synthesized
gagaaccuuaugguccagg

SEQ ID NO: 2110 - RNA, 19 nt, artificial
  Chemically synthesized
ggaugccuacuggguggag

SEQ ID NO: 2111 - RNA, 19 nt, artificial
  Chemically synthesized
cugauccuucauaugaagc

SEQ ID NO: 2112 - RNA, 19 nt, artificial
  Chemically synthesized
aucccaugugcguggccag

SEQ ID NO: 2113 - RNA, 19 nt, artificial
  Chemically synthesized
aaugugaaaaucaccgaug

SEQ ID NO: 2114 - RNA, 19 nt, artificial
  Chemically synthesized
auccagcacacgaauacac

SEQ ID NO: 2115 - RNA, 19 nt, artificial
  Chemically synthesized
uacagugagcgggaugccu

SEQ ID NO: 2116 - RNA, 19 nt, artificial
  Chemically synthesized
ucaauucagaauguaaguc

SEQ ID NO: 2117 - RNA, 19 nt, artificial
  Chemically synthesized
aauaacuucauuugcuccu

SEQ ID NO: 2118 - RNA, 19 nt, artificial
  Chemically synthesized
uuuucagaacuauccacug

SEQ ID NO: 2119 - RNA, 19 nt, artificial
  Chemically synthesized
uuuuucagaacuauccacu

SEQ ID NO: 2120 - RNA, 19 nt, artificial
  Chemically synthesized
uccugcugauccugcucac

SEQ ID NO: 2121 - RNA, 19 nt, artificial
  Chemically synthesized
uuccagaaauaaguugaug

SEQ ID NO: 2122 - RNA, 19 nt, artificial
  Chemically synthesized
aucuacagagcuaugagcc

SEQ ID NO: 2123 - RNA, 19 nt, artificial
  Chemically synthesized
aaugacagaguuauagauc

SEQ ID NO: 2124 - RNA, 19 nt, artificial
  Chemically synthesized
uagauccagguaaagugga

SEQ ID NO: 2125 - RNA, 19 nt, artificial
  Chemically synthesized
aaaugaugugggccuggcu

SEQ ID NO: 2126 - RNA, 19 nt, artificial
  Chemically synthesized
ugggccuggcuccaggcca

SEQ ID NO: 2127 - RNA, 19 nt, artificial
  Chemically synthesized
ugcugugcucuguuccugc

SEQ ID NO: 2128 - RNA, 19 nt, artificial
  Chemically synthesized
gaggaugccuggcccucuc

SEQ ID NO: 2129 - RNA, 19 nt, artificial
  Chemically synthesized
uaaacuuacugggaaaucc

SEQ ID NO: 2130 - RNA, 19 nt, artificial
  Chemically synthesized
auaagcgggacuucauucc

SEQ ID NO: 2131 - RNA, 19 nt, artificial
  Chemically synthesized
augaaaaugaugugggccu

SEQ ID NO: 2132 - RNA, 19 nt, artificial
  Chemically synthesized
cugugcucuguuccugcug

SEQ ID NO: 2133 - RNA, 19 nt, artificial
  Chemically synthesized
aaagaaaagauuuugcugg

SEQ ID NO: 2134 - RNA, 19 nt, artificial
  Chemically synthesized
aacaaugaugcugccauuc

SEQ ID NO: 2135 - RNA, 19 nt, artificial
  Chemically synthesized
gugagcgggaugccuacug

SEQ ID NO: 2136 - RNA, 19 nt, artificial
  Chemically synthesized
uuacugcuggagauuuuug

SEQ ID NO: 2137 - RNA, 19 nt, artificial
  Chemically synthesized
aguaaaguuuuucugguuc

SEQ ID NO: 2138 - RNA, 19 nt, artificial
  Chemically synthesized
uuuccgucuuuuugaugag

SEQ ID NO: 2139 - RNA, 19 nt, artificial
  Chemically synthesized
uugccgcaacucaaagaac

SEQ ID NO: 2140 - RNA, 19 nt, artificial
  Chemically synthesized
aauuugccgcaacucaaag

SEQ ID NO: 2141 - RNA, 19 nt, artificial
  Chemically synthesized
ucaggagcagcaagcacug

SEQ ID NO: 2142 - RNA, 19 nt, artificial
  Chemically synthesized
uggauggugugggucuugg

SEQ ID NO: 2143 - RNA, 19 nt, artificial
  Chemically synthesized
ugaccuguccaacaacagg

SEQ ID NO: 2144 - RNA, 19 nt, artificial
  Chemically synthesized
auauuugaacuuauccagc

SEQ ID NO: 2145 - RNA, 19 nt, artificial
  Chemically synthesized
aagaauccuccaaucaggc

SEQ ID NO: 2146 - RNA, 19 nt, artificial
  Chemically synthesized
ugacuccauugaaaagagc

SEQ ID NO: 2147 - RNA, 19 nt, artificial
  Chemically synthesized
cuucucugucuugugaccg

SEQ ID NO: 2148 - RNA, 19 nt, artificial
  Chemically synthesized
cagaugccucccucuuacc

SEQ ID NO: 2149 - RNA, 19 nt, artificial
  Chemically synthesized
ucuccaucccaugugcgug

SEQ ID NO: 2150 - RNA, 19 nt, artificial
  Chemically synthesized
cuuaugguccaggagcugg

SEQ ID NO: 2151 - RNA, 19 nt, artificial
  Chemically synthesized
guuccugcugauccugcuc

SEQ ID NO: 2152 - RNA, 19 nt, artificial
  Chemically synthesized
aagauucuuuuucuucccu

SEQ ID NO: 2153 - RNA, 19 nt, artificial
  Chemically synthesized
uucacucaggagcagcaag

SEQ ID NO: 2154 - RNA, 19 nt, artificial
  Chemically synthesized
aucuuuaaacuccauuccc

SEQ ID NO: 2155 - RNA, 19 nt, artificial
  Chemically synthesized
aagcccaggaaagcuccca

SEQ ID NO: 2156 - RNA, 19 nt, artificial
  Chemically synthesized
ugaaaaugaugugggccug

SEQ ID NO: 2157 - RNA, 19 nt, artificial
  Chemically synthesized
caagaccuaccuggagugg

SEQ ID NO: 2158 - RNA, 19 nt, artificial
  Chemically synthesized
ucccucuuacccauguuac

SEQ ID NO: 2159 - RNA, 19 nt, artificial
  Chemically synthesized
accuuccuugaggaacuug

SEQ ID NO: 2160 - RNA, 19 nt, artificial
  Chemically synthesized
aggaugccuggcccucucu

SEQ ID NO: 2161 - RNA, 19 nt, artificial
  Chemically synthesized
acacuggaaauuuuagaug

SEQ ID NO: 2162 - RNA, 19 nt, artificial
  Chemically synthesized
auccagguaaaguggaaac

SEQ ID NO: 2163 - RNA, 19 nt, artificial
  Chemically synthesized
ugacucuccaucccaugug

SEQ ID NO: 2164 - RNA, 19 nt, artificial
  Chemically synthesized
auuaacacaauagaggaag

SEQ ID NO: 2165 - RNA, 19 nt, artificial
  Chemically synthesized
uuuugcuggacuuaccuuc

SEQ ID NO: 2166 - RNA, 19 nt, artificial
  Chemically synthesized
uuugcuggacuuaccuucc

SEQ ID NO: 2167 - RNA, 19 nt, artificial
  Chemically synthesized
uuauagauccagguaaagu

SEQ ID NO: 2168 - RNA, 19 nt, artificial
  Chemically synthesized
uuggaacugcgagauacug

SEQ ID NO: 2169 - RNA, 19 nt, artificial
  Chemically synthesized
aaccuuaugguccaggagc

SEQ ID NO: 2170 - RNA, 19 nt, artificial
  Chemically synthesized
ugaggaugccuggcccucu

SEQ ID NO: 2171 - RNA, 19 nt, artificial
  Chemically synthesized
uugaacuuauccagcacac

SEQ ID NO: 2172 - RNA, 19 nt, artificial
  Chemically synthesized
ucuaccagaugccucccuc

SEQ ID NO: 2173 - RNA, 19 nt, artificial
  Chemically synthesized
uaaaguuuuucugguuccu

SEQ ID NO: 2174 - RNA, 19 nt, artificial
  Chemically synthesized
ugucuggcaugugcugugc

SEQ ID NO: 2175 - RNA, 19 nt, artificial
  Chemically synthesized
acauacuuuguggauggug

SEQ ID NO: 2176 - RNA, 19 nt, artificial
  Chemically synthesized
ugccucccucuuacccaug

SEQ ID NO: 2177 - RNA, 19 nt, artificial
  Chemically synthesized
uccuccaaucaggcuucuc

SEQ ID NO: 2178 - RNA, 19 nt, artificial
  Chemically synthesized
uuauccagcacacgaauac

SEQ ID NO: 2179 - RNA, 19 nt, artificial
  Chemically synthesized
gcgcuucugcaagcugcgg

SEQ ID NO: 2180 - RNA, 19 nt, artificial
  Chemically synthesized
auacuugaaaaauucagcc

SEQ ID NO: 2181 - RNA, 19 nt, artificial
  Chemically synthesized
gagcgggaugccuacuggg

SEQ ID NO: 2182 - RNA, 19 nt, artificial
  Chemically synthesized
uuccugcugauccugcuca

SEQ ID NO: 2183 - RNA, 19 nt, artificial
  Chemically synthesized
auucagccugugaggaugc

SEQ ID NO: 2184 - RNA, 19 nt, artificial
  Chemically synthesized
aaaaagccuugaccugucc

SEQ ID NO: 2185 - RNA, 19 nt, artificial
  Chemically synthesized
ugugaggaugccuggcccu

SEQ ID NO: 2186 - RNA, 19 nt, artificial
  Chemically synthesized
uguaacaggcugcauuccc

SEQ ID NO: 2187 - RNA, 19 nt, artificial
  Chemically synthesized
auagauccagguaaagugg

SEQ ID NO: 2188 - RNA, 19 nt, artificial
  Chemically synthesized
acucaggagcagcaagcac

SEQ ID NO: 2189 - RNA, 19 nt, artificial
  Chemically synthesized
uugcuccugugaauuccuc

SEQ ID NO: 2190 - RNA, 19 nt, artificial
  Chemically synthesized
augugcugugcucuguucc

SEQ ID NO: 2191 - RNA, 19 nt, artificial
  Chemically synthesized
auuggccagcaaauuaccu

SEQ ID NO: 2192 - RNA, 19 nt, artificial
  Chemically synthesized
gaagcccaggaaagcuccc

SEQ ID NO: 2193 - RNA, 19 nt, artificial
  Chemically synthesized
uaugaacuggacuucuccc

SEQ ID NO: 2194 - RNA, 19 nt, artificial
  Chemically synthesized
aauuaccugugugacucuc

SEQ ID NO: 2195 - RNA, 19 nt, artificial
  Chemically synthesized
uugugucuucauaagcggg

SEQ ID NO: 2196 - RNA, 19 nt, artificial
  Chemically synthesized
cuguuccugcugauccugc

SEQ ID NO: 2197 - RNA, 19 nt, artificial
  Chemically synthesized
gaccuaccuggaguggccc

SEQ ID NO: 2198 - RNA, 19 nt, artificial
  Chemically synthesized
aaugccacauacuuugugg

SEQ ID NO: 2199 - RNA, 19 nt, artificial
  Chemically synthesized
gccugugaggaugccuggc

SEQ ID NO: 2200 - RNA, 19 nt, artificial
  Chemically synthesized
uaugccugaaacuugucag

SEQ ID NO: 2201 - RNA, 19 nt, artificial
  Chemically synthesized
uuguuucuuacagugagcg

SEQ ID NO: 2202 - RNA, 19 nt, artificial
  Chemically synthesized
gaugugggccuggcuccag

SEQ ID NO: 2203 - RNA, 19 nt, artificial
  Chemically synthesized
uucaggauguccgccucuc

SEQ ID NO: 2204 - RNA, 19 nt, artificial
  Chemically synthesized
cugugaggaugccuggccc

SEQ ID NO: 2205 - RNA, 19 nt, artificial
  Chemically synthesized
ugagcgggaugccuacugg

SEQ ID NO: 2206 - RNA, 19 nt, artificial
  Chemically synthesized
uuuggguaaaucugagagc

SEQ ID NO: 2207 - RNA, 19 nt, artificial
  Chemically synthesized
uaaacuccauucccucagg

SEQ ID NO: 2208 - RNA, 19 nt, artificial
  Chemically synthesized
auuaccugugugacucucc

SEQ ID NO: 2209 - RNA, 19 nt, artificial
  Chemically synthesized
ucagccugugaggaugccu

SEQ ID NO: 2210 - RNA, 19 nt, artificial
  Chemically synthesized
uagaggaagauucuuuuuc

SEQ ID NO: 2211 - RNA, 19 nt, artificial
  Chemically synthesized
acucuccaucccaugugcg

SEQ ID NO: 2212 - RNA, 19 nt, artificial
  Chemically synthesized
uuugaauuugccgcaacuc

SEQ ID NO: 2213 - RNA, 19 nt, artificial
  Chemically synthesized
uuuuucuucccugggcagu

SEQ ID NO: 2214 - RNA, 19 nt, artificial
  Chemically synthesized
acuuuguggaugguguggg

SEQ ID NO: 2215 - RNA, 19 nt, artificial
  Chemically synthesized
uugaccuguccaacaacag

SEQ ID NO: 2216 - RNA, 19 nt, artificial
  Chemically synthesized
augaugugggccuggcucc

SEQ ID NO: 2217 - RNA, 19 nt, artificial
  Chemically synthesized
ccaggccaaaaggaagccc

SEQ ID NO: 2218 - RNA, 19 nt, artificial
  Chemically synthesized
ucacucaggagcagcaagc

SEQ ID NO: 2219 - RNA, 19 nt, artificial
  Chemically synthesized
aagaccuaccuggaguggc

SEQ ID NO: 2220 - RNA, 19 nt, artificial
  Chemically synthesized
uaccuggaguggcccaugg

SEQ ID NO: 2221 - RNA, 19 nt, artificial
  Chemically synthesized
uacuuuguggauggugugg

SEQ ID NO: 2222 - RNA, 19 nt, artificial
  Chemically synthesized
caggagcagcaagcacugg

SEQ ID NO: 2223 - RNA, 19 nt, artificial
  Chemically synthesized
aggagcagcaagcacuggc

SEQ ID NO: 2224 - RNA, 19 nt, artificial
  Chemically synthesized
ucuguuccugcugauccug

SEQ ID NO: 2225 - RNA, 19 nt, artificial
  Chemically synthesized
acucuaccagaugccuccc

SEQ ID NO: 2226 - RNA, 19 nt, artificial
  Chemically synthesized
gaaaaugaugugggccugg

SEQ ID NO: 2227 - RNA, 19 nt, artificial
  Chemically synthesized
augugggccuggcuccagg

SEQ ID NO: 2228 - RNA, 19 nt, artificial
  Chemically synthesized
aacaguaaaguuuuucugg

SEQ ID NO: 2229 - RNA, 19 nt, artificial
  Chemically synthesized
uccuucacucaggagcagc

SEQ ID NO: 2230 - RNA, 19 nt, artificial
  Chemically synthesized
uaugguccaggagcuggag

SEQ ID NO: 2231 - RNA, 19 nt, artificial
  Chemically synthesized
gugaggaugccuggcccuc

SEQ ID NO: 2232 - RNA, 19 nt, artificial
  Chemically synthesized
uccagguaaaguggaaacg

SEQ ID NO: 2233 - RNA, 19 nt, artificial
  Chemically synthesized
agaugccucccucuuaccc

SEQ ID NO: 2234 - RNA, 19 nt, artificial
  Chemically synthesized
aagcagcauauuuuacugc

SEQ ID NO: 2235 - RNA, 19 nt, artificial
  Chemically synthesized
ccaucccaugugcguggcc

SEQ ID NO: 2236 - RNA, 19 nt, artificial
  Chemically synthesized
aaugaugugggccuggcuc

SEQ ID NO: 2237 - RNA, 19 nt, artificial
  Chemically synthesized
uuuuggguaaaucugagag

SEQ ID NO: 2238 - RNA, 19 nt, artificial
  Chemically synthesized
uuuucuuugaauuugccgc

SEQ ID NO: 2239 - RNA, 19 nt, artificial
  Chemically synthesized
auucuuuuucuucccuggg

SEQ ID NO: 2240 - RNA, 19 nt, artificial
  Chemically synthesized
uuaaacuuacugggaaauc

SEQ ID NO: 2241 - RNA, 19 nt, artificial
  Chemically synthesized
uuggccagcaaauuaccug

SEQ ID NO: 2242 - RNA, 19 nt, artificial
  Chemically synthesized
auuuucuuugaauuugccg

SEQ ID NO: 2243 - RNA, 19 nt, artificial
  Chemically synthesized
uucuuuuucuucccugggc

SEQ ID NO: 2244 - RNA, 19 nt, artificial
  Chemically synthesized
ccugugaggaugccuggcc

SEQ ID NO: 2245 - RNA, 19 nt, artificial
  Chemically synthesized
uccaucccaugugcguggc

SEQ ID NO: 2246 - RNA, 19 nt, artificial
  Chemically synthesized
uuaaacuccauucccucag

SEQ ID NO: 2247 - RNA, 19 nt, artificial
  Chemically synthesized
uccaggccaaaaggaagcc

SEQ ID NO: 2248 - RNA, 19 nt, artificial
  Chemically synthesized
ugugggccuggcuccaggc

SEQ ID NO: 2249 - RNA, 19 nt, artificial
  Chemically synthesized
aaaaugaugugggccuggc

SEQ ID NO: 2250 - RNA, 19 nt, artificial
  Chemically synthesized
uuuguggaugguguggguc

SEQ ID NO: 2251 - RNA, 19 nt, artificial
  Chemically synthesized
ucccaugugcguggccagc

SEQ ID NO: 2252 - RNA, 19 nt, artificial
  Chemically synthesized
uuacagugagcgggaugcc

SEQ ID NO: 2253 - RNA, 19 nt, artificial
  Chemically synthesized
uaugaaaaugaugugggcc

SEQ ID NO: 2254 - RNA, 19 nt, artificial
  Chemically synthesized
uucagccugugaggaugcc

SEQ ID NO: 2255 - RNA, 19 nt, artificial
  Chemically synthesized
ggcuuuuuucucaaugggc

SEQ ID NO: 2256 - RNA, 19 nt, artificial
  Chemically synthesized
aguuuaaagauccugagcu

SEQ ID NO: 2257 - RNA, 19 nt, artificial
  Chemically synthesized
gaaacgguggcacaggacc

SEQ ID NO: 2258 - RNA, 19 nt, artificial
  Chemically synthesized
cucuguaggucacuguugc

SEQ ID NO: 2259 - RNA, 19 nt, artificial
  Chemically synthesized
gaaugcagccuguuacacu

SEQ ID NO: 2260 - RNA, 19 nt, artificial
  Chemically synthesized
aacauuccacggaacuugu

SEQ ID NO: 2261 - RNA, 19 nt, artificial
  Chemically synthesized
ucggugauuuucacauuuc

SEQ ID NO: 2262 - RNA, 19 nt, artificial
  Chemically synthesized
gaagguguccauauuuccc

SEQ ID NO: 2263 - RNA, 19 nt, artificial
  Chemically synthesized
ugauauugucaaugaucca

SEQ ID NO: 2264 - RNA, 19 nt, artificial
  Chemically synthesized
gaaucuuagugaagguguc

SEQ ID NO: 2265 - RNA, 19 nt, artificial
  Chemically synthesized
gucuugggaaugcagccug

SEQ ID NO: 2266 - RNA, 19 nt, artificial
  Chemically synthesized
aaaaucuccagcaguaaaa

SEQ ID NO: 2267 - RNA, 19 nt, artificial
  Chemically synthesized
guguuaauuccauuggaug

SEQ ID NO: 2268 - RNA, 19 nt, artificial
  Chemically synthesized
uccauuaaggguacaguca

SEQ ID NO: 2269 - RNA, 19 nt, artificial
  Chemically synthesized
uaggcaucccgcucacugu

SEQ ID NO: 2270 - RNA, 19 nt, artificial
  Chemically synthesized
uuuuggccuggagccaggc

SEQ ID NO: 2271 - RNA, 19 nt, artificial
  Chemically synthesized
ugcuaauguaggugauccu

SEQ ID NO: 2272 - RNA, 19 nt, artificial
  Chemically synthesized
aaggaucagaugacuuaca

SEQ ID NO: 2273 - RNA, 19 nt, artificial
  Chemically synthesized
gucuugguguucauuaucu

SEQ ID NO: 2274 - RNA, 19 nt, artificial
  Chemically synthesized
uauugucaaugauccacuu

SEQ ID NO: 2275 - RNA, 19 nt, artificial
  Chemically synthesized
cuuccuuuuggccuggagc

SEQ ID NO: 2276 - RNA, 19 nt, artificial
  Chemically synthesized
guucauuaucuuccgcagc

SEQ ID NO: 2277 - RNA, 19 nt, artificial
  Chemically synthesized
uggagucaaugauauuguc

SEQ ID NO: 2278 - RNA, 19 nt, artificial
  Chemically synthesized
cucacuguaagaaacaaau

SEQ ID NO: 2279 - RNA, 19 nt, artificial
  Chemically synthesized
caaaucaguaucucgcagu

SEQ ID NO: 2280 - RNA, 19 nt, artificial
  Chemically synthesized
agaucugaagcaucaaucu

SEQ ID NO: 2281 - RNA, 19 nt, artificial
  Chemically synthesized
uuuggccuggagccaggcc

SEQ ID NO: 2282 - RNA, 19 nt, artificial
  Chemically synthesized
auuggaugucagcaccaga

SEQ ID NO: 2283 - RNA, 19 nt, artificial
  Chemically synthesized
ucuccacccaguaggcauc

SEQ ID NO: 2284 - RNA, 19 nt, artificial
  Chemically synthesized
gauugaaguucuccagcuc

SEQ ID NO: 2285 - RNA, 19 nt, artificial
  Chemically synthesized
ccuguuacacuguguauuc

SEQ ID NO: 2286 - RNA, 19 nt, artificial
  Chemically synthesized
ugcagccuguuacacugug

SEQ ID NO: 2287 - RNA, 19 nt, artificial
  Chemically synthesized
gaggcggacauccugaacc

SEQ ID NO: 2288 - RNA, 19 nt, artificial
  Chemically synthesized
ucuguaggucacuguugcu

SEQ ID NO: 2289 - RNA, 19 nt, artificial
  Chemically synthesized
cuccauuaaggguacaguc

SEQ ID NO: 2290 - RNA, 19 nt, artificial
  Chemically synthesized
cauccacaaaguauguggc

SEQ ID NO: 2291 - RNA, 19 nt, artificial
  Chemically synthesized
gguaaguccagcaaaaucu

SEQ ID NO: 2292 - RNA, 19 nt, artificial
  Chemically synthesized
ugagauuguuguugcuaac

SEQ ID NO: 2293 - RNA, 19 nt, artificial
  Chemically synthesized
gucacaagacagagaagcc

SEQ ID NO: 2294 - RNA, 19 nt, artificial
  Chemically synthesized
cacacagguaauuugcugg

SEQ ID NO: 2295 - RNA, 19 nt, artificial
  Chemically synthesized
acuugcaccacucacucuu

SEQ ID NO: 2296 - RNA, 19 nt, artificial
  Chemically synthesized
gagucaucaacuuauuucu

SEQ ID NO: 2297 - RNA, 19 nt, artificial
  Chemically synthesized
ucuaaaauuuccagugucu

SEQ ID NO: 2298 - RNA, 19 nt, artificial
  Chemically synthesized
aaagauccugagcugcccu

SEQ ID NO: 2299 - RNA, 19 nt, artificial
  Chemically synthesized
ggguuuuguaaggauuucc

SEQ ID NO: 2300 - RNA, 19 nt, artificial
  Chemically synthesized
ucuuccuuggagaggcuga

SEQ ID NO: 2301 - RNA, 19 nt, artificial
  Chemically synthesized
auaaagugcucagaucaua

SEQ ID NO: 2302 - RNA, 19 nt, artificial
  Chemically synthesized
ucacaggagcaaaugaagu

SEQ ID NO: 2303 - RNA, 19 nt, artificial
  Chemically synthesized
acaaaguuuucagaaagca

SEQ ID NO: 2304 - RNA, 19 nt, artificial
  Chemically synthesized
aagacaguuuuguggcucu

SEQ ID NO: 2305 - RNA, 19 nt, artificial
  Chemically synthesized
acaugccagacaccagugc

SEQ ID NO: 2306 - RNA, 19 nt, artificial
  Chemically synthesized
cgcagcucucagauuuacc

SEQ ID NO: 2307 - RNA, 19 nt, artificial
  Chemically synthesized
ggaagaaaaagaaucuucc

SEQ ID NO: 2308 - RNA, 19 nt, artificial
  Chemically synthesized
uuuccacuuuaccuggauc

SEQ ID NO: 2309 - RNA, 19 nt, artificial
  Chemically synthesized
gauauugucaaugauccac

SEQ ID NO: 2310 - RNA, 19 nt, artificial
  Chemically synthesized
gauuggaggauucuuccuu

SEQ ID NO: 2311 - RNA, 19 nt, artificial
  Chemically synthesized
guuacacuguguauucgug

SEQ ID NO: 2312 - RNA, 19 nt, artificial
  Chemically synthesized
aauaugcugcuucauauga

SEQ ID NO: 2313 - RNA, 19 nt, artificial
  Chemically synthesized
aucuuccgcagcuugcaga

SEQ ID NO: 2314 - RNA, 19 nt, artificial
  Chemically synthesized
ccauccacaaaguaugugg

SEQ ID NO: 2315 - RNA, 19 nt, artificial
  Chemically synthesized
accagcuuccaaagucuuc

SEQ ID NO: 2316 - RNA, 19 nt, artificial
  Chemically synthesized
auugagauuguuguugcua

SEQ ID NO: 2317 - RNA, 19 nt, artificial
  Chemically synthesized
ggucacaagacagagaagc

SEQ ID NO: 2318 - RNA, 19 nt, artificial
  Chemically synthesized
uugcaccacucacucuuca

SEQ ID NO: 2319 - RNA, 19 nt, artificial
  Chemically synthesized
ugcugcuucauaugaagga

SEQ ID NO: 2320 - RNA, 19 nt, artificial
  Chemically synthesized
uuauugccaccagcuucca

SEQ ID NO: 2321 - RNA, 19 nt, artificial
  Chemically synthesized
uuguagagagggccaggca

SEQ ID NO: 2322 - RNA, 19 nt, artificial
  Chemically synthesized
ugggcuuccuuuuggccug

SEQ ID NO: 2323 - RNA, 19 nt, artificial
  Chemically synthesized
augaaguuauugccaccag

SEQ ID NO: 2324 - RNA, 19 nt, artificial
  Chemically synthesized
ucauagcucuguagaucug

SEQ ID NO: 2325 - RNA, 19 nt, artificial
  Chemically synthesized
agucaucaacuuauuucug

SEQ ID NO: 2326 - RNA, 19 nt, artificial
  Chemically synthesized
ccagcuuccaaagucuuca

SEQ ID NO: 2327 - RNA, 19 nt, artificial
  Chemically synthesized
agugcuugcugcuccugag

SEQ ID NO: 2328 - RNA, 19 nt, artificial
  Chemically synthesized
aucuaaaauuuccaguguc

SEQ ID NO: 2329 - RNA, 19 nt, artificial
  Chemically synthesized
aggucuugguguucauuau

SEQ ID NO: 2330 - RNA, 19 nt, artificial
  Chemically synthesized
cuacugugauucuuuuaac

SEQ ID NO: 2331 - RNA, 19 nt, artificial
  Chemically synthesized
aauuuguuucaccagugga

SEQ ID NO: 2332 - RNA, 19 nt, artificial
  Chemically synthesized
ucaguaucucgcaguucca

SEQ ID NO: 2333 - RNA, 19 nt, artificial
  Chemically synthesized
aaaucuccagcaguaaaau

SEQ ID NO: 2334 - RNA, 19 nt, artificial
  Chemically synthesized
cuugguguucauuaucuuc

SEQ ID NO: 2335 - RNA, 19 nt, artificial
  Chemically synthesized
acacagguaauuugcuggc

SEQ ID NO: 2336 - RNA, 19 nt, artificial
  Chemically synthesized
acuugccaggaaugaaguc

SEQ ID NO: 2337 - RNA, 19 nt, artificial
  Chemically synthesized
ucagcaggaacagagcaca

SEQ ID NO: 2338 - RNA, 19 nt, artificial
  Chemically synthesized
ggauugaaguucuccagcu

SEQ ID NO: 2339 - RNA, 19 nt, artificial
  Chemically synthesized
aauuuccagugucuuggga

SEQ ID NO: 2340 - RNA, 19 nt, artificial
  Chemically synthesized
uagugaagguguccauauu

SEQ ID NO: 2341 - RNA, 19 nt, artificial
  Chemically synthesized
ccacuugccaggaaugaag

SEQ ID NO: 2342 - RNA, 19 nt, artificial
  Chemically synthesized
uccuguuguuggacagguc

SEQ ID NO: 2343 - RNA, 19 nt, artificial
  Chemically synthesized
aguuccucaaggaagguaa

SEQ ID NO: 2344 - RNA, 19 nt, artificial
  Chemically synthesized
uauaaagugcucagaucau

SEQ ID NO: 2345 - RNA, 19 nt, artificial
  Chemically synthesized
uaggguuuuguaaggauuu

SEQ ID NO: 2346 - RNA, 19 nt, artificial
  Chemically synthesized
gcaucugguagagucauca

SEQ ID NO: 2347 - RNA, 19 nt, artificial
  Chemically synthesized
gagaaguccaguucauacu

SEQ ID NO: 2348 - RNA, 19 nt, artificial
  Chemically synthesized
ugagucaaguugcuccuua

SEQ ID NO: 2349 - RNA, 19 nt, artificial
  Chemically synthesized
accuggaucuauaacucug

SEQ ID NO: 2350 - RNA, 19 nt, artificial
  Chemically synthesized
gacuucaaacuuuuuggcu

SEQ ID NO: 2351 - RNA, 19 nt, artificial
  Chemically synthesized
gaucugaagcaucaaucuc

SEQ ID NO: 2352 - RNA, 19 nt, artificial
  Chemically synthesized
gucacuguugcuaauguag

SEQ ID NO: 2353 - RNA, 19 nt, artificial
  Chemically synthesized
uucccaguaaguuuaagaa

SEQ ID NO: 2354 - RNA, 19 nt, artificial
  Chemically synthesized
uuaaggguacagucaucaa

SEQ ID NO: 2355 - RNA, 19 nt, artificial
  Chemically synthesized
guccaguucauacuugcac

SEQ ID NO: 2356 - RNA, 19 nt, artificial
  Chemically synthesized
acucuucacaaaguuuuca

SEQ ID NO: 2357 - RNA, 19 nt, artificial
  Chemically synthesized
ccucuauuguguuaauucc

SEQ ID NO: 2358 - RNA, 19 nt, artificial
  Chemically synthesized
caucaaucucaaguuccuc

SEQ ID NO: 2359 - RNA, 19 nt, artificial
  Chemically synthesized
gucaucaacuuauuucugg

SEQ ID NO: 2360 - RNA, 19 nt, artificial
  Chemically synthesized
ucuuccucuauuguguuaa

SEQ ID NO: 2361 - RNA, 19 nt, artificial
  Chemically synthesized
augccagacaccagugcug

SEQ ID NO: 2362 - RNA, 19 nt, artificial
  Chemically synthesized
acuguguauucgugugcug

SEQ ID NO: 2363 - RNA, 19 nt, artificial
  Chemically synthesized
auucgugugcuggauaagu

SEQ ID NO: 2364 - RNA, 19 nt, artificial
  Chemically synthesized
aaguugcuccuuagaaaac

SEQ ID NO: 2365 - RNA, 19 nt, artificial
  Chemically synthesized
aguucuccagcuccuggac

SEQ ID NO: 2366 - RNA, 19 nt, artificial
  Chemically synthesized
aaagcacaaagacaguuuu

SEQ ID NO: 2367 - RNA, 19 nt, artificial
  Chemically synthesized
gaagcaucaaucucaaguu

SEQ ID NO: 2368 - RNA, 19 nt, artificial
  Chemically synthesized
gaaaaaagagauguuuccc

SEQ ID NO: 2369 - RNA, 19 nt, artificial
  Chemically synthesized
caaugaauuuguuucacca

SEQ ID NO: 2370 - RNA, 19 nt, artificial
  Chemically synthesized
ucuuuucuggccacugaca

SEQ ID NO: 2371 - RNA, 19 nt, artificial
  Chemically synthesized
cauuaucuuccgcagcuug

SEQ ID NO: 2372 - RNA, 19 nt, artificial
  Chemically synthesized
cagucaucaaacucuaauu

SEQ ID NO: 2373 - RNA, 19 nt, artificial
  Chemically synthesized
cuuucaucggugauuuuca

SEQ ID NO: 2374 - RNA, 19 nt, artificial
  Chemically synthesized
augaaggaucagaugacuu

SEQ ID NO: 2375 - RNA, 19 nt, artificial
  Chemically synthesized
aguuuuguggcucuuuuca

SEQ ID NO: 2376 - RNA, 19 nt, artificial
  Chemically synthesized
aauucacaggagcaaauga

SEQ ID NO: 2377 - RNA, 19 nt, artificial
  Chemically synthesized
aacaaggaaccagaaaaac

SEQ ID NO: 2378 - RNA, 19 nt, artificial
  Chemically synthesized
cgcuuaugaagacacaacu

SEQ ID NO: 2379 - RNA, 19 nt, artificial
  Chemically synthesized
aagacggaaaugggagaag

SEQ ID NO: 2380 - RNA, 19 nt, artificial
  Chemically synthesized
ucugaaaaauggaaagugu

SEQ ID NO: 2381 - RNA, 19 nt, artificial
  Chemically synthesized
aaaucaguaucucgcaguu

SEQ ID NO: 2382 - RNA, 19 nt, artificial
  Chemically synthesized
cacaagacagagaagccug

SEQ ID NO: 2383 - RNA, 19 nt, artificial
  Chemically synthesized
aagcacaaagacaguuuug

SEQ ID NO: 2384 - RNA, 19 nt, artificial
  Chemically synthesized
uguuucaccaguggauagu

SEQ ID NO: 2385 - RNA, 19 nt, artificial
  Chemically synthesized
gucaaugauauugucaaug

SEQ ID NO: 2386 - RNA, 19 nt, artificial
  Chemically synthesized
gauccaaguauucuaauga

SEQ ID NO: 2387 - RNA, 19 nt, artificial
  Chemically synthesized
guuuuguaaggauuuccca

SEQ ID NO: 2388 - RNA, 19 nt, artificial
  Chemically synthesized
agcacaugccagacaccag

SEQ ID NO: 2389 - RNA, 19 nt, artificial
  Chemically synthesized
agauccugagcugcccuug

SEQ ID NO: 2390 - RNA, 19 nt, artificial
  Chemically synthesized
ugguagagucaucaacuua

SEQ ID NO: 2391 - RNA, 19 nt, artificial
  Chemically synthesized
ugagaugagaaaaaagaga

SEQ ID NO: 2392 - RNA, 19 nt, artificial
  Chemically synthesized
aucucaaguuccucaagga

SEQ ID NO: 2393 - RNA, 19 nt, artificial
  Chemically synthesized
caaggaagguaaguccagc

SEQ ID NO: 2394 - RNA, 19 nt, artificial
  Chemically synthesized
aaugaagucccgcuuauga

SEQ ID NO: 2395 - RNA, 19 nt, artificial
  Chemically synthesized
uggcucauagcucuguaga

SEQ ID NO: 2396 - RNA, 19 nt, artificial
  Chemically synthesized
ugccaggaaugaagucccg

SEQ ID NO: 2397 - RNA, 19 nt, artificial
  Chemically synthesized
augaauuuguuucaccagu

SEQ ID NO: 2398 - RNA, 19 nt, artificial
  Chemically synthesized
uaaguccagcaaaaucuuu

SEQ ID NO: 2399 - RNA, 19 nt, artificial
  Chemically synthesized
acaguuuuguggcucuuuu

SEQ ID NO: 2400 - RNA, 19 nt, artificial
  Chemically synthesized
uggcucuuuucaauggagu

SEQ ID NO: 2401 - RNA, 19 nt, artificial
  Chemically synthesized
uggcagcaucauuguucuc

SEQ ID NO: 2402 - RNA, 19 nt, artificial
  Chemically synthesized
ucauuaucuuccgcagcuu

SEQ ID NO: 2403 - RNA, 19 nt, artificial
  Chemically synthesized
cagcaguaaaauaugcugc

SEQ ID NO: 2404 - RNA, 19 nt, artificial
  Chemically synthesized
uggagaggcugaugaugac

SEQ ID NO: 2405 - RNA, 19 nt, artificial
  Chemically synthesized
aaguuuguagagagggcca

SEQ ID NO: 2406 - RNA, 19 nt, artificial
  Chemically synthesized
uccugagcugcccuugcag

SEQ ID NO: 2407 - RNA, 19 nt, artificial
  Chemically synthesized
cagagaagccugauuggag

SEQ ID NO: 2408 - RNA, 19 nt, artificial
  Chemically synthesized
uacuaguaacauggguaag

SEQ ID NO: 2409 - RNA, 19 nt, artificial
  Chemically synthesized
caguuuuguggcucuuuuc

SEQ ID NO: 2410 - RNA, 19 nt, artificial
  Chemically synthesized
auggaguuuaaagauccug

SEQ ID NO: 2411 - RNA, 19 nt, artificial
  Chemically synthesized
auggaaacgguggcacagg

SEQ ID NO: 2412 - RNA, 19 nt, artificial
  Chemically synthesized
caguuccaaacauuccacg

SEQ ID NO: 2413 - RNA, 19 nt, artificial
  Chemically synthesized
uccgcagcuugcagaagcg

SEQ ID NO: 2414 - RNA, 19 nt, artificial
  Chemically synthesized
ccugugacauuccgacacc

SEQ ID NO: 2415 - RNA, 19 nt, artificial
  Chemically synthesized
ucaucaaaaagacggaaau

SEQ ID NO: 2416 - RNA, 19 nt, artificial
  Chemically synthesized
cuuuucaauggagucaaug

SEQ ID NO: 2417 - RNA, 19 nt, artificial
  Chemically synthesized
ugcuggauaaguucaaaua

SEQ ID NO: 2418 - RNA, 19 nt, artificial
  Chemically synthesized
aagucccgcuuaugaagac

SEQ ID NO: 2419 - RNA, 19 nt, artificial
  Chemically synthesized
ggaccauaagguucuccac

SEQ ID NO: 2420 - RNA, 19 nt, artificial
  Chemically synthesized
uuggccagugcuugcugcu

SEQ ID NO: 2421 - RNA, 19 nt, artificial
  Chemically synthesized
gaaguuauugccaccagcu

SEQ ID NO: 2422 - RNA, 19 nt, artificial
  Chemically synthesized
caugccagacaccagugcu

SEQ ID NO: 2423 - RNA, 19 nt, artificial
  Chemically synthesized
gaaucuuccucuauugugu

SEQ ID NO: 2424 - RNA, 19 nt, artificial
  Chemically synthesized
caguaaaauaugcugcuuc

SEQ ID NO: 2425 - RNA, 19 nt, artificial
  Chemically synthesized
aaucuuccucuauuguguu

SEQ ID NO: 2426 - RNA, 19 nt, artificial
  Chemically synthesized
agagcacagcacaugccag

SEQ ID NO: 2427 - RNA, 19 nt, artificial
  Chemically synthesized
cugaaacaaacuuucaucg

SEQ ID NO: 2428 - RNA, 19 nt, artificial
  Chemically synthesized
cugcuucauaugaaggauc

SEQ ID NO: 2429 - RNA, 19 nt, artificial
  Chemically synthesized
auagcucuguagaucugaa

SEQ ID NO: 2430 - RNA, 19 nt, artificial
  Chemically synthesized
agucaaguuuuucagagug

SEQ ID NO: 2431 - RNA, 19 nt, artificial
  Chemically synthesized
cagcaucauuguucucauc

SEQ ID NO: 2432 - RNA, 19 nt, artificial
  Chemically synthesized
acagcacaugccagacacc

SEQ ID NO: 2433 - RNA, 19 nt, artificial
  Chemically synthesized
ugcuucauaugaaggauca

SEQ ID NO: 2434 - RNA, 19 nt, artificial
  Chemically synthesized
agcaggaacagagcacagc

SEQ ID NO: 2435 - RNA, 19 nt, artificial
  Chemically synthesized
cuaacaauccagaaaucug

SEQ ID NO: 2436 - RNA, 19 nt, artificial
  Chemically synthesized
auuucccaguaaguuuaag

SEQ ID NO: 2437 - RNA, 19 nt, artificial
  Chemically synthesized
uuggacaggucaaggcuuu

SEQ ID NO: 2438 - RNA, 19 nt, artificial
  Chemically synthesized
guaagagggaggcaucugg

SEQ ID NO: 2439 - RNA, 19 nt, artificial
  Chemically synthesized
aaggauuucccaguaaguu

SEQ ID NO: 2440 - RNA, 19 nt, artificial
  Chemically synthesized
augaagucccgcuuaugaa

SEQ ID NO: 2441 - RNA, 19 nt, artificial
  Chemically synthesized
cccaagacccacaccaucc

SEQ ID NO: 2442 - RNA, 19 nt, artificial
  Chemically synthesized
agcacaaagacaguuuugu

SEQ ID NO: 2443 - RNA, 19 nt, artificial
  Chemically synthesized
aguaucucgcaguuccaaa

SEQ ID NO: 2444 - RNA, 19 nt, artificial
  Chemically synthesized
auggguaagagggaggcau

SEQ ID NO: 2445 - RNA, 19 nt, artificial
  Chemically synthesized
cagcuuccaaagucuucag

SEQ ID NO: 2446 - RNA, 19 nt, artificial
  Chemically synthesized
acauggguaagagggaggc

SEQ ID NO: 2447 - RNA, 19 nt, artificial
  Chemically synthesized
acuuuacuguuuucuacug

SEQ ID NO: 2448 - RNA, 19 nt, artificial
  Chemically synthesized
uccagcaaaaucuuuucuu

SEQ ID NO: 2449 - RNA, 19 nt, artificial
  Chemically synthesized
agggaauggaguuuaaaga

SEQ ID NO: 2450 - RNA, 19 nt, artificial
  Chemically synthesized
cucgcaguuccaaacauuc

SEQ ID NO: 2451 - RNA, 19 nt, artificial
  Chemically synthesized
guuuucuacugugauucuu

SEQ ID NO: 2452 - RNA, 19 nt, artificial
  Chemically synthesized
ugcuugcugcuccugagug

SEQ ID NO: 2453 - RNA, 19 nt, artificial
  Chemically synthesized
aucucgcaguuccaaacau

SEQ ID NO: 2454 - RNA, 19 nt, artificial
  Chemically synthesized
gaaguucuccagcuccugg

SEQ ID NO: 2455 - RNA, 19 nt, artificial
  Chemically synthesized
gguucuccacccaguaggc

SEQ ID NO: 2456 - RNA, 19 nt, artificial
  Chemically synthesized
cucauagcucuguagaucu

SEQ ID NO: 2457 - RNA, 19 nt, artificial
  Chemically synthesized
uaugcagccuccggauugu

SEQ ID NO: 2458 - RNA, 19 nt, artificial
  Chemically synthesized
agguaggucuugguguuca

SEQ ID NO: 2459 - RNA, 19 nt, artificial
  Chemically synthesized
cuuuccugggcuuccuuuu

SEQ ID NO: 2460 - RNA, 19 nt, artificial
  Chemically synthesized
ggauaguucugaaaaaugg

SEQ ID NO: 2461 - RNA, 19 nt, artificial
  Chemically synthesized
cucacaggcugaauuuuuc

SEQ ID NO: 2462 - RNA, 19 nt, artificial
  Chemically synthesized
ucugaagcaucaaucucaa

SEQ ID NO: 2463 - RNA, 19 nt, artificial
  Chemically synthesized
ggguacagucaucaaacuc

SEQ ID NO: 2464 - RNA, 19 nt, artificial
  Chemically synthesized
acucacucuucacaaaguu

SEQ ID NO: 2465 - RNA, 19 nt, artificial
  Chemically synthesized
cucuauuguguuaauucca

SEQ ID NO: 2466 - RNA, 19 nt, artificial
  Chemically synthesized
guaggcaucccgcucacug

SEQ ID NO: 2467 - RNA, 19 nt, artificial
  Chemically synthesized
augcagccuguuacacugu

SEQ ID NO: 2468 - RNA, 19 nt, artificial
  Chemically synthesized
ucuugggaaugcagccugu

SEQ ID NO: 2469 - RNA, 19 nt, artificial
  Chemically synthesized
guuuguagagagggccagg

SEQ ID NO: 2470 - RNA, 19 nt, artificial
  Chemically synthesized
ggagaggcugaugaugacc

SEQ ID NO: 2471 - RNA, 19 nt, artificial
  Chemically synthesized
agcaguaaaauaugcugcu

SEQ ID NO: 2472 - RNA, 19 nt, artificial
  Chemically synthesized
uacagucaucaaacucuaa

SEQ ID NO: 2473 - RNA, 19 nt, artificial
  Chemically synthesized
gaaguccaguucauacuug

SEQ ID NO: 2474 - RNA, 19 nt, artificial
  Chemically synthesized
uguugcuaauguaggugau

SEQ ID NO: 2475 - RNA, 19 nt, artificial
  Chemically synthesized
ucgcagcucucagauuuac

SEQ ID NO: 2476 - RNA, 19 nt, artificial
  Chemically synthesized
acuguuuucuacugugauu

SEQ ID NO: 2477 - RNA, 19 nt, artificial
  Chemically synthesized
uccacuugccaggaaugaa

SEQ ID NO: 2478 - RNA, 19 nt, artificial
  Chemically synthesized
caucauuguucucaucaaa

SEQ ID NO: 2479 - RNA, 19 nt, artificial
  Chemically synthesized
gggauugaaguucuccagc

SEQ ID NO: 2480 - RNA, 19 nt, artificial
  Chemically synthesized
ccaggaaugaagucccgcu

SEQ ID NO: 2481 - RNA, 19 nt, artificial
  Chemically synthesized
ucaaacuuuuuggcucaua

SEQ ID NO: 2482 - RNA, 19 nt, artificial
  Chemically synthesized
cacucuucacaaaguuuuc

SEQ ID NO: 2483 - RNA, 19 nt, artificial
  Chemically synthesized
gucccgcuuaugaagacac

SEQ ID NO: 2484 - RNA, 19 nt, artificial
  Chemically synthesized
aggauucuuccuuggagag

SEQ ID NO: 2485 - RNA, 19 nt, artificial
  Chemically synthesized
uugggaaugcagccuguua

SEQ ID NO: 2486 - RNA, 19 nt, artificial
  Chemically synthesized
uccacccaguaggcauccc

SEQ ID NO: 2487 - RNA, 19 nt, artificial
  Chemically synthesized
ggucuugguguucauuauc

SEQ ID NO: 2488 - RNA, 19 nt, artificial
  Chemically synthesized
gaaggaucagaugacuuac

SEQ ID NO: 2489 - RNA, 19 nt, artificial
  Chemically synthesized
uccaaacauuccacggaac

SEQ ID NO: 2490 - RNA, 19 nt, artificial
  Chemically synthesized
auccugagcugcccuugca

SEQ ID NO: 2491 - RNA, 19 nt, artificial
  Chemically synthesized
augggagaaguccaguuca

SEQ ID NO: 2492 - RNA, 19 nt, artificial
  Chemically synthesized
gaauucacaggagcaaaug

SEQ ID NO: 2493 - RNA, 19 nt, artificial
  Chemically synthesized
uugcugcuccugagugaag

SEQ ID NO: 2494 - RNA, 19 nt, artificial
  Chemically synthesized
aaugauccacuugccagga

SEQ ID NO: 2495 - RNA, 19 nt, artificial
  Chemically synthesized
aacaauccagaaaucugau

SEQ ID NO: 2496 - RNA, 19 nt, artificial
  Chemically synthesized
uguggcucuuuucaaugga

SEQ ID NO: 2497 - RNA, 19 nt, artificial
  Chemically synthesized
aauuugcuggccaaucaau

SEQ ID NO: 2498 - RNA, 19 nt, artificial
  Chemically synthesized
uggaguuuaaagauccuga

SEQ ID NO: 2499 - RNA, 19 nt, artificial
  Chemically synthesized
agaaagcacaaagacaguu

SEQ ID NO: 2500 - RNA, 19 nt, artificial
  Chemically synthesized
cauuggaugucagcaccag

SEQ ID NO: 2501 - RNA, 19 nt, artificial
  Chemically synthesized
agacuuuggccagugcuug

SEQ ID NO: 2502 - RNA, 19 nt, artificial
  Chemically synthesized
uggaggauucuuccuugga

SEQ ID NO: 2503 - RNA, 19 nt, artificial
  Chemically synthesized
agaugacuuacauucugaa

SEQ ID NO: 2504 - RNA, 19 nt, artificial
  Chemically synthesized
aaucuccagcaguaaaaua

SEQ ID NO: 2505 - RNA, 19 nt, artificial
  Chemically synthesized
cuucauaugaaggaucaga

SEQ ID NO: 2506 - RNA, 19 nt, artificial
  Chemically synthesized
cuguuacacuguguauucg

SEQ ID NO: 2507 - RNA, 19 nt, artificial
  Chemically synthesized
ggaugucagcaccagagcc

SEQ ID NO: 2508 - RNA, 19 nt, artificial
  Chemically synthesized
accauccacaaaguaugug

SEQ ID NO: 2509 - RNA, 19 nt, artificial
  Chemically synthesized
uggguaagagggaggcauc

SEQ ID NO: 2510 - RNA, 19 nt, artificial
  Chemically synthesized
guuguuggacaggucaagg

SEQ ID NO: 2511 - RNA, 19 nt, artificial
  Chemically synthesized
aggauuucccaguaaguuu

SEQ ID NO: 2512 - RNA, 19 nt, artificial
  Chemically synthesized
cucaaguuccucaaggaag

SEQ ID NO: 2513 - RNA, 19 nt, artificial
  Chemically synthesized
gagucacacagguaauuug

SEQ ID NO: 2514 - RNA, 19 nt, artificial
  Chemically synthesized
caccucuguaggucacugu

SEQ ID NO: 2515 - RNA, 19 nt, artificial
  Chemically synthesized
aguccagcaaaaucuuuuc

SEQ ID NO: 2516 - RNA, 19 nt, artificial
  Chemically synthesized
agaaguccaguucauacuu

SEQ ID NO: 2517 - RNA, 19 nt, artificial
  Chemically synthesized
uaauuugcuggccaaucaa

SEQ ID NO: 2518 - RNA, 19 nt, artificial
  Chemically synthesized
ggaggcaucugguagaguc

SEQ ID NO: 2519 - RNA, 19 nt, artificial
  Chemically synthesized
guaaggauuucccaguaag

SEQ ID NO: 2520 - RNA, 19 nt, artificial
  Chemically synthesized
agacggaaaugggagaagu

SEQ ID NO: 2521 - RNA, 19 nt, artificial
  Chemically synthesized
cuguguauucgugugcugg

SEQ ID NO: 2522 - RNA, 19 nt, artificial
  Chemically synthesized
caauuuugugagaugagaa

SEQ ID NO: 2523 - RNA, 19 nt, artificial
  Chemically synthesized
gaaugaagucccgcuuaug

SEQ ID NO: 2524 - RNA, 19 nt, artificial
  Chemically synthesized
aagacagagaagccugauu

SEQ ID NO: 2525 - RNA, 19 nt, artificial
  Chemically synthesized
cagugucuugggaaugcag

SEQ ID NO: 2526 - RNA, 19 nt, artificial
  Chemically synthesized
uuccaaacauuccacggaa

SEQ ID NO: 2527 - RNA, 19 nt, artificial
  Chemically synthesized
caggcugaauuuuucaagu

SEQ ID NO: 2528 - RNA, 19 nt, artificial
  Chemically synthesized
aagaaucuuccucuauugu

SEQ ID NO: 2529 - RNA, 19 nt, artificial
  Chemically synthesized
guacagucaucaaacucua

SEQ ID NO: 2530 - RNA, 19 nt, artificial
  Chemically synthesized
cacagcacaugccagacac

SEQ ID NO: 2531 - RNA, 19 nt, artificial
  Chemically synthesized
gagucaaguugcuccuuag

SEQ ID NO: 2532 - RNA, 19 nt, artificial
  Chemically synthesized
ccacucacucuucacaaag

SEQ ID NO: 2533 - RNA, 19 nt, artificial
  Chemically synthesized
cugggcuuccuuuuggccu

SEQ ID NO: 2534 - RNA, 19 nt, artificial
  Chemically synthesized
agugaagguguccauauuu

SEQ ID NO: 2535 - RNA, 19 nt, artificial
  Chemically synthesized
uuccucaaggaagguaagu

SEQ ID NO: 2536 - RNA, 19 nt, artificial
  Chemically synthesized
ccaccagcuuccaaagucu

SEQ ID NO: 2537 - RNA, 19 nt, artificial
  Chemically synthesized
agguaaguccagcaaaauc

SEQ ID NO: 2538 - RNA, 19 nt, artificial
  Chemically synthesized
cauuaaggguacagucauc

SEQ ID NO: 2539 - RNA, 19 nt, artificial
  Chemically synthesized
acgcacaugggauggagag

SEQ ID NO: 2540 - RNA, 19 nt, artificial
  Chemically synthesized
ugccagacaccagugcugu

SEQ ID NO: 2541 - RNA, 19 nt, artificial
  Chemically synthesized
agagggaggcaucugguag

SEQ ID NO: 2542 - RNA, 19 nt, artificial
  Chemically synthesized
aguccaguucauacuugca

SEQ ID NO: 2543 - RNA, 19 nt, artificial
  Chemically synthesized
gaaagcacaaagacaguuu

SEQ ID NO: 2544 - RNA, 19 nt, artificial
  Chemically synthesized
cuuggagaggcugaugaug

SEQ ID NO: 2545 - RNA, 19 nt, artificial
  Chemically synthesized
gcagcaucauuguucucau

SEQ ID NO: 2546 - RNA, 19 nt, artificial
  Chemically synthesized
uuguaaggauuucccagua

SEQ ID NO: 2547 - RNA, 19 nt, artificial
  Chemically synthesized
ccagggaagaaaaagaauc

SEQ ID NO: 2548 - RNA, 19 nt, artificial
  Chemically synthesized
ccugggcuuccuuuuggcc

SEQ ID NO: 2549 - RNA, 19 nt, artificial
  Chemically synthesized
aggaucagaugacuuacau

SEQ ID NO: 2550 - RNA, 19 nt, artificial
  Chemically synthesized
acaugggauggagagucac

SEQ ID NO: 2551 - RNA, 19 nt, artificial
  Chemically synthesized
cuuccuuggagaggcugau

SEQ ID NO: 2552 - RNA, 19 nt, artificial
  Chemically synthesized
cuaauguaggugauccugu

SEQ ID NO: 2553 - RNA, 19 nt, artificial
  Chemically synthesized
uauugccaccagcuuccaa

SEQ ID NO: 2554 - RNA, 19 nt, artificial
  Chemically synthesized
ggccacuccagguaggucu

SEQ ID NO: 2555 - RNA, 19 nt, artificial
  Chemically synthesized
cuauaacucugucauuauc

SEQ ID NO: 2556 - RNA, 19 nt, artificial
  Chemically synthesized
caguucauacuugcaccac

SEQ ID NO: 2557 - RNA, 19 nt, artificial
  Chemically synthesized
aaaaaucuccagcaguaaa

SEQ ID NO: 2558 - RNA, 19 nt, artificial
  Chemically synthesized
cuugcaccacucacucuuc

SEQ ID NO: 2559 - RNA, 19 nt, artificial
  Chemically synthesized
cuaauucuaacaauccaga

SEQ ID NO: 2560 - RNA, 19 nt, artificial
  Chemically synthesized
ggagaaguccaguucauac

SEQ ID NO: 2561 - RNA, 19 nt, artificial
  Chemically synthesized
cuuuacuguuuucuacugu

SEQ ID NO: 2562 - RNA, 19 nt, artificial
  Chemically synthesized
gcacaugggauggagaguc

SEQ ID NO: 2563 - RNA, 19 nt, artificial
  Chemically synthesized
ugaguugcggcaaauucaa

SEQ ID NO: 2564 - RNA, 19 nt, artificial
  Chemically synthesized
caccaguggauaguucuga

SEQ ID NO: 2565 - RNA, 19 nt, artificial
  Chemically synthesized
ggaggauucuuccuuggag

SEQ ID NO: 2566 - RNA, 19 nt, artificial
  Chemically synthesized
auccuguuguuggacaggu

SEQ ID NO: 2567 - RNA, 19 nt, artificial
  Chemically synthesized
cuccagguaggucuuggug

SEQ ID NO: 2568 - RNA, 19 nt, artificial
  Chemically synthesized
ucucagauuuacccaaaau

SEQ ID NO: 2569 - RNA, 19 nt, artificial
  Chemically synthesized
aauaugcagccuccggauu

SEQ ID NO: 2570 - RNA, 19 nt, artificial
  Chemically synthesized
ccgcuuaugaagacacaac

SEQ ID NO: 2571 - RNA, 19 nt, artificial
  Chemically synthesized
gcaguuccaaacauuccac

SEQ ID NO: 2572 - RNA, 19 nt, artificial
  Chemically synthesized
agagucacacagguaauuu

SEQ ID NO: 2573 - RNA, 19 nt, artificial
  Chemically synthesized
gcucauagcucuguagauc

SEQ ID NO: 2574 - RNA, 19 nt, artificial
  Chemically synthesized
acagagaagccugauugga

SEQ ID NO: 2575 - RNA, 19 nt, artificial
  Chemically synthesized
agaauggcagcaucauugu

SEQ ID NO: 2576 - RNA, 19 nt, artificial
  Chemically synthesized
cacuguguauucgugugcu

SEQ ID NO: 2577 - RNA, 19 nt, artificial
  Chemically synthesized
aggucacuguugcuaaugu

SEQ ID NO: 2578 - RNA, 19 nt, artificial
  Chemically synthesized
agccugauuggaggauucu

SEQ ID NO: 2579 - RNA, 19 nt, artificial
  Chemically synthesized
acuuuggccagugcuugcu

SEQ ID NO: 2580 - RNA, 19 nt, artificial
  Chemically synthesized
uguauucgugugcuggaua

SEQ ID NO: 2581 - RNA, 19 nt, artificial
  Chemically synthesized
aauggaguuuaaagauccu

SEQ ID NO: 2582 - RNA, 19 nt, artificial
  Chemically synthesized
guagaucugaagcaucaau

SEQ ID NO: 2583 - RNA, 19 nt, artificial
  Chemically synthesized
cacuguugcuaauguaggu

SEQ ID NO: 2584 - RNA, 19 nt, artificial
  Chemically synthesized
cuguagaucugaagcauca

SEQ ID NO: 2585 - RNA, 19 nt, artificial
  Chemically synthesized
aaguuccucaaggaaggua

SEQ ID NO: 2586 - RNA, 19 nt, artificial
  Chemically synthesized
cagcaaaaucuuuucuuug

SEQ ID NO: 2587 - RNA, 19 nt, artificial
  Chemically synthesized
gguguucauuaucuuccgc

SEQ ID NO: 2588 - RNA, 19 nt, artificial
  Chemically synthesized
caaggaaccagaaaaacuu

SEQ ID NO: 2589 - RNA, 19 nt, artificial
  Chemically synthesized
uguagaucugaagcaucaa

SEQ ID NO: 2590 - RNA, 19 nt, artificial
  Chemically synthesized
cugugauucuuuuaacucu

SEQ ID NO: 2591 - RNA, 19 nt, artificial
  Chemically synthesized
agcuugcagaagcgcuggg

SEQ ID NO: 2592 - RNA, 19 nt, artificial
  Chemically synthesized
gauccugagcugcccuugc

SEQ ID NO: 2593 - RNA, 19 nt, artificial
  Chemically synthesized
aaguuuucagaaagcacaa

SEQ ID NO: 2594 - RNA, 19 nt, artificial
  Chemically synthesized
aggaacagagcacagcaca

SEQ ID NO: 2595 - RNA, 19 nt, artificial
  Chemically synthesized
cagccuguuacacugugua

SEQ ID NO: 2596 - RNA, 19 nt, artificial
  Chemically synthesized
aggguacagucaucaaacu

SEQ ID NO: 2597 - RNA, 19 nt, artificial
  Chemically synthesized
uguguauucgugugcugga

SEQ ID NO: 2598 - RNA, 19 nt, artificial
  Chemically synthesized
acagguaauuugcuggcca

SEQ ID NO: 2599 - RNA, 19 nt, artificial
  Chemically synthesized
aucggugauuuucacauuu

SEQ ID NO: 2600 - RNA, 19 nt, artificial
  Chemically synthesized
uguaggugauccuguuguu

SEQ ID NO: 2601 - RNA, 19 nt, artificial
  Chemically synthesized
cuaguaacauggguaagag

SEQ ID NO: 2602 - RNA, 19 nt, artificial
  Chemically synthesized
gaaaguaaacaaggaacca

SEQ ID NO: 2603 - RNA, 19 nt, artificial
  Chemically synthesized
gggaauggcuuuuuucuca

SEQ ID NO: 2604 - RNA, 19 nt, artificial
  Chemically synthesized
ccucuguaggucacuguug

SEQ ID NO: 2605 - RNA, 19 nt, artificial
  Chemically synthesized
gguagagucaucaacuuau

SEQ ID NO: 2606 - RNA, 19 nt, artificial
  Chemically synthesized
aucccgcucacuguaagaa

SEQ ID NO: 2607 - RNA, 19 nt, artificial
  Chemically synthesized
guugcuaauguaggugauc

SEQ ID NO: 2608 - RNA, 19 nt, artificial
  Chemically synthesized
gcacaaagacaguuuugug

SEQ ID NO: 2609 - RNA, 19 nt, artificial
  Chemically synthesized
caaucucaaguuccucaag

SEQ ID NO: 2610 - RNA, 19 nt, artificial
  Chemically synthesized
gaggauucuuccuuggaga

SEQ ID NO: 2611 - RNA, 19 nt, artificial
  Chemically synthesized
auccucacaggcugaauuu

SEQ ID NO: 2612 - RNA, 19 nt, artificial
  Chemically synthesized
ggcagcaucauuguucuca

SEQ ID NO: 2613 - RNA, 19 nt, artificial
  Chemically synthesized
cuuuaucgcagcucucaga

SEQ ID NO: 2614 - RNA, 19 nt, artificial
  Chemically synthesized
agaugagaaaaaagagaug

SEQ ID NO: 2615 - RNA, 19 nt, artificial
  Chemically synthesized
gugaagguguccauauuuc

SEQ ID NO: 2616 - RNA, 19 nt, artificial
  Chemically synthesized
gagggaauggaguuuaaag

SEQ ID NO: 2617 - RNA, 19 nt, artificial
  Chemically synthesized
uugcggcaaauucaaagaa

SEQ ID NO: 2618 - RNA, 19 nt, artificial
  Chemically synthesized
ucaaugggcuccagaagaa

SEQ ID NO: 2619 - RNA, 19 nt, artificial
  Chemically synthesized
cagcucucagauuuaccca

SEQ ID NO: 2620 - RNA, 19 nt, artificial
  Chemically synthesized
gaauuuguuucaccagugg

SEQ ID NO: 2621 - RNA, 19 nt, artificial
  Chemically synthesized
ccacccaguaggcaucccg

SEQ ID NO: 2622 - RNA, 19 nt, artificial
  Chemically synthesized
caucuacaaaaaucuccag

SEQ ID NO: 2623 - RNA, 19 nt, artificial
  Chemically synthesized
aguaaaauaugcugcuuca

SEQ ID NO: 2624 - RNA, 19 nt, artificial
  Chemically synthesized
ucuuugaguugcggcaaau

SEQ ID NO: 2625 - RNA, 19 nt, artificial
  Chemically synthesized
cuccuggaccauaagguuc

SEQ ID NO: 2626 - RNA, 19 nt, artificial
  Chemically synthesized
ugggagaaguccaguucau

SEQ ID NO: 2627 - RNA, 19 nt, artificial
  Chemically synthesized
aaagacggaaaugggagaa

SEQ ID NO: 2628 - RNA, 19 nt, artificial
  Chemically synthesized
accucuguaggucacuguu

SEQ ID NO: 2629 - RNA, 19 nt, artificial
  Chemically synthesized
accaguggauaguucugaa

SEQ ID NO: 2630 - RNA, 19 nt, artificial
  Chemically synthesized
guagagucaucaacuuauu

SEQ ID NO: 2631 - RNA, 19 nt, artificial
  Chemically synthesized
agcacagcacaugccagac

SEQ ID NO: 2632 - RNA, 19 nt, artificial
  Chemically synthesized
gcucuguagaucugaagca

SEQ ID NO: 2633 - RNA, 19 nt, artificial
  Chemically synthesized
auccacuugccaggaauga

SEQ ID NO: 2634 - RNA, 19 nt, artificial
  Chemically synthesized
aagauccugagcugcccuu

SEQ ID NO: 2635 - RNA, 19 nt, artificial
  Chemically synthesized
ugacaaguuucaggcauag

SEQ ID NO: 2636 - RNA, 19 nt, artificial
  Chemically synthesized
cagaugacuuacauucuga

SEQ ID NO: 2637 - RNA, 19 nt, artificial
  Chemically synthesized
ggaauggaguuuaaagauc

SEQ ID NO: 2638 - RNA, 19 nt, artificial
  Chemically synthesized
ggaauaugcagccuccgga

SEQ ID NO: 2639 - RNA, 19 nt, artificial
  Chemically synthesized
gccuguuacacuguguauu

SEQ ID NO: 2640 - RNA, 19 nt, artificial
  Chemically synthesized
uguagagagggccaggcau

SEQ ID NO: 2641 - RNA, 19 nt, artificial
  Chemically synthesized
cauagcucuguagaucuga

SEQ ID NO: 2642 - RNA, 19 nt, artificial
  Chemically synthesized
uucuuugaguugcggcaaa

SEQ ID NO: 2643 - RNA, 19 nt, artificial
  Chemically synthesized
cucaaggaagguaagucca

SEQ ID NO: 2644 - RNA, 19 nt, artificial
  Chemically synthesized
uccaugggccacuccaggu

SEQ ID NO: 2645 - RNA, 19 nt, artificial
  Chemically synthesized
agccuguuacacuguguau

SEQ ID NO: 2646 - RNA, 19 nt, artificial
  Chemically synthesized
cacuugccaggaaugaagu

SEQ ID NO: 2647 - RNA, 19 nt, artificial
  Chemically synthesized
ucccaguaaguuuaagaau

SEQ ID NO: 2648 - RNA, 19 nt, artificial
  Chemically synthesized
cuucaaacuuuuuggcuca

SEQ ID NO: 2649 - RNA, 19 nt, artificial
  Chemically synthesized
cacaaaguuuucagaaagc

SEQ ID NO: 2650 - RNA, 19 nt, artificial
  Chemically synthesized
gccaggaaugaagucccgc

SEQ ID NO: 2651 - RNA, 19 nt, artificial
  Chemically synthesized
gaugagaaaaaagagaugu

SEQ ID NO: 2652 - RNA, 19 nt, artificial
  Chemically synthesized
aaacaaggaaccagaaaaa

SEQ ID NO: 2653 - RNA, 19 nt, artificial
  Chemically synthesized
ggagcuuuccugggcuucc

SEQ ID NO: 2654 - RNA, 19 nt, artificial
  Chemically synthesized
auggagagucacacaggua

SEQ ID NO: 2655 - RNA, 19 nt, artificial
  Chemically synthesized
accagaaaaacuuuacugu

SEQ ID NO: 2656 - RNA, 19 nt, artificial
  Chemically synthesized
uucaaacuuuuuggcucau

SEQ ID NO: 2657 - RNA, 19 nt, artificial
  Chemically synthesized
ggauaagucuaaauguuca

SEQ ID NO: 2658 - RNA, 19 nt, artificial
  Chemically synthesized
guuuuguggcucuuuucaa

SEQ ID NO: 2659 - RNA, 19 nt, artificial
  Chemically synthesized
gaugacuuacauucugaau

SEQ ID NO: 2660 - RNA, 19 nt, artificial
  Chemically synthesized
uggccacgcacaugggaug

SEQ ID NO: 2661 - RNA, 19 nt, artificial
  Chemically synthesized
aaguuauugccaccagcuu

SEQ ID NO: 2662 - RNA, 19 nt, artificial
  Chemically synthesized
cgcaguuccaaacauucca

SEQ ID NO: 2663 - RNA, 19 nt, artificial
  Chemically synthesized
agaggcggacauccugaac

SEQ ID NO: 2664 - RNA, 19 nt, artificial
  Chemically synthesized
cugaaaaauggaaaguguc

SEQ ID NO: 2665 - RNA, 19 nt, artificial
  Chemically synthesized
gauaguucugaaaaaugga

SEQ ID NO: 2666 - RNA, 19 nt, artificial
  Chemically synthesized
aaaagacggaaaugggaga

SEQ ID NO: 2667 - RNA, 19 nt, artificial
  Chemically synthesized
cugaagcaucaaucucaag

SEQ ID NO: 2668 - RNA, 19 nt, artificial
  Chemically synthesized
guaauuugcuggccaauca

SEQ ID NO: 2669 - RNA, 19 nt, artificial
  Chemically synthesized
ugcccagggaagaaaaaga

SEQ ID NO: 2670 - RNA, 19 nt, artificial
  Chemically synthesized
aggguuuuguaaggauuuc

SEQ ID NO: 2671 - RNA, 19 nt, artificial
  Chemically synthesized
cauaugaaggaucagauga

SEQ ID NO: 2672 - RNA, 19 nt, artificial
  Chemically synthesized
ugggauggagagucacaca

SEQ ID NO: 2673 - RNA, 19 nt, artificial
  Chemically synthesized
cccgcucacuguaagaaac

SEQ ID NO: 2674 - RNA, 19 nt, artificial
  Chemically synthesized
acuaguaacauggguaaga

SEQ ID NO: 2675 - RNA, 19 nt, artificial
  Chemically synthesized
ucucaucaaaaagacggaa

SEQ ID NO: 2676 - RNA, 19 nt, artificial
  Chemically synthesized
ggaucuauaacucugucau

SEQ ID NO: 2677 - RNA, 19 nt, artificial
  Chemically synthesized
cuccagcaguaaaauaugc

SEQ ID NO: 2678 - RNA, 19 nt, artificial
  Chemically synthesized
ggaaaugggagaaguccag

SEQ ID NO: 2679 - RNA, 19 nt, artificial
  Chemically synthesized
cauccucacaggcugaauu

SEQ ID NO: 2680 - RNA, 19 nt, artificial
  Chemically synthesized
gaauaugcagccuccggau

SEQ ID NO: 2681 - RNA, 19 nt, artificial
  Chemically synthesized
caagacccacaccauccac

SEQ ID NO: 2682 - RNA, 19 nt, artificial
  Chemically synthesized
agucccgcuuaugaagaca

SEQ ID NO: 2683 - RNA, 19 nt, artificial
  Chemically synthesized
augggccacuccagguagg

SEQ ID NO: 2684 - RNA, 19 nt, artificial
  Chemically synthesized
cauuccuacugauuuucaa

SEQ ID NO: 2685 - RNA, 19 nt, artificial
  Chemically synthesized
guaggugauccuguuguug

SEQ ID NO: 2686 - RNA, 19 nt, artificial
  Chemically synthesized
caaagacaguuuuguggcu

SEQ ID NO: 2687 - RNA, 19 nt, artificial
  Chemically synthesized
gagucaaugauauugucaa

SEQ ID NO: 2688 - RNA, 19 nt, artificial
  Chemically synthesized
gaaacaaacuuucaucggu

SEQ ID NO: 2689 - RNA, 19 nt, artificial
  Chemically synthesized
cacaugccagacaccagug

SEQ ID NO: 2690 - RNA, 19 nt, artificial
  Chemically synthesized
gauccacuugccaggaaug

SEQ ID NO: 2691 - RNA, 19 nt, artificial
  Chemically synthesized
acaaaaaucuccagcagua

SEQ ID NO: 2692 - RNA, 19 nt, artificial
  Chemically synthesized
auccacaaaguauguggca

SEQ ID NO: 2693 - RNA, 19 nt, artificial
  Chemically synthesized
gugagaugagaaaaaagag

SEQ ID NO: 2694 - RNA, 19 nt, artificial
  Chemically synthesized
ggauucuuccuuggagagg

SEQ ID NO: 2695 - RNA, 19 nt, artificial
  Chemically synthesized
ucuuccgcagcuugcagaa

SEQ ID NO: 2696 - RNA, 19 nt, artificial
  Chemically synthesized
agucaaguugcuccuuaga

SEQ ID NO: 2697 - RNA, 19 nt, artificial
  Chemically synthesized
ugcuggccacgcacauggg

SEQ ID NO: 2698 - RNA, 19 nt, artificial
  Chemically synthesized
cacagguaauuugcuggcc

SEQ ID NO: 2699 - RNA, 19 nt, artificial
  Chemically synthesized
ucccgcuuaugaagacaca

SEQ ID NO: 2700 - RNA, 19 nt, artificial
  Chemically synthesized
agcucucagauuuacccaa

SEQ ID NO: 2701 - RNA, 19 nt, artificial
  Chemically synthesized
gucacacagguaauuugcu

SEQ ID NO: 2702 - RNA, 19 nt, artificial
  Chemically synthesized
ucccgcucacuguaagaaa

SEQ ID NO: 2703 - RNA, 19 nt, artificial
  Chemically synthesized
gacggaaaugggagaaguc

SEQ ID NO: 2704 - RNA, 19 nt, artificial
  Chemically synthesized
agcuuuccugggcuuccuu

SEQ ID NO: 2705 - RNA, 19 nt, artificial
  Chemically synthesized
ccaacuccauuaaggguac

SEQ ID NO: 2706 - RNA, 19 nt, artificial
  Chemically synthesized
cggugauuuucacauuucu

SEQ ID NO: 2707 - RNA, 19 nt, artificial
  Chemically synthesized
gggaagaaaaagaaucuuc

SEQ ID NO: 2708 - RNA, 19 nt, artificial
  Chemically synthesized
guggcucuuuucaauggag

SEQ ID NO: 2709 - RNA, 19 nt, artificial
  Chemically synthesized
cccaguaaguuuaagaaug

SEQ ID NO: 2710 - RNA, 19 nt, artificial
  Chemically synthesized
cucuguagaucugaagcau

SEQ ID NO: 2711 - RNA, 19 nt, artificial
  Chemically synthesized
cuuagugaagguguccaua

SEQ ID NO: 2712 - RNA, 19 nt, artificial
  Chemically synthesized
agcaggaucagcaggaaca

SEQ ID NO: 2713 - RNA, 19 nt, artificial
  Chemically synthesized
cacccaguaggcaucccgc

SEQ ID NO: 2714 - RNA, 19 nt, artificial
  Chemically synthesized
cacaccauccacaaaguau

SEQ ID NO: 2715 - RNA, 19 nt, artificial
  Chemically synthesized
aagguaaguccagcaaaau

SEQ ID NO: 2716 - RNA, 19 nt, artificial
  Chemically synthesized
ugcggcaaauucaaagaaa

SEQ ID NO: 2717 - RNA, 19 nt, artificial
  Chemically synthesized
gcaucaaucucaaguuccu

SEQ ID NO: 2718 - RNA, 19 nt, artificial
  Chemically synthesized
gagaugagaaaaaagagau

SEQ ID NO: 2719 - RNA, 19 nt, artificial
  Chemically synthesized
ccagugucuugggaaugca

SEQ ID NO: 2720 - RNA, 19 nt, artificial
  Chemically synthesized
ccaaaucaguaucucgcag

SEQ ID NO: 2721 - RNA, 19 nt, artificial
  Chemically synthesized
ggagcaaaugaaguuauug

SEQ ID NO: 2722 - RNA, 19 nt, artificial
  Chemically synthesized
uccacaaaguauguggcau

SEQ ID NO: 2723 - RNA, 19 nt, artificial
  Chemically synthesized
acccaguaggcaucccgcu

SEQ ID NO: 2724 - RNA, 19 nt, artificial
  Chemically synthesized
cuguaggucacuguugcua

SEQ ID NO: 2725 - RNA, 19 nt, artificial
  Chemically synthesized
gcucacuguaagaaacaaa

SEQ ID NO: 2726 - RNA, 19 nt, artificial
  Chemically synthesized
cuucacaaaguuuucagaa

SEQ ID NO: 2727 - RNA, 19 nt, artificial
  Chemically synthesized
cugaauugacuucaaacuu

SEQ ID NO: 2728 - RNA, 19 nt, artificial
  Chemically synthesized
ugcagccuccggauuguua

SEQ ID NO: 2729 - RNA, 19 nt, artificial
  Chemically synthesized
uggaaacgguggcacagga

SEQ ID NO: 2730 - RNA, 19 nt, artificial
  Chemically synthesized
cuacaaaaaucuccagcag

SEQ ID NO: 2731 - RNA, 19 nt, artificial
  Chemically synthesized
aggcggacauccugaaccu

SEQ ID NO: 2732 - RNA, 19 nt, artificial
  Chemically synthesized
uccagcuccuggaccauaa

SEQ ID NO: 2733 - RNA, 19 nt, artificial
  Chemically synthesized
cuggaucuauaacucuguc

SEQ ID NO: 2734 - RNA, 19 nt, artificial
  Chemically synthesized
guagagagggccaggcauc

SEQ ID NO: 2735 - RNA, 19 nt, artificial
  Chemically synthesized
caggaacagagcacagcac

SEQ ID NO: 2736 - RNA, 19 nt, artificial
  Chemically synthesized
cggaaaugggagaagucca

SEQ ID NO: 2737 - RNA, 19 nt, artificial
  Chemically synthesized
uccuuuuggccuggagcca

SEQ ID NO: 2738 - RNA, 19 nt, artificial
  Chemically synthesized
acaaacuuucaucggugau

SEQ ID NO: 2739 - RNA, 19 nt, artificial
  Chemically synthesized
cucuaauucuaacaaucca

SEQ ID NO: 2740 - RNA, 19 nt, artificial
  Chemically synthesized
ccauaagguucuccaccca

SEQ ID NO: 2741 - RNA, 19 nt, artificial
  Chemically synthesized
gucaaguugcuccuuagaa

SEQ ID NO: 2742 - RNA, 19 nt, artificial
  Chemically synthesized
gaauggcuuuuuucucaau

SEQ ID NO: 2743 - RNA, 19 nt, artificial
  Chemically synthesized
gccaccagcuuccaaaguc

SEQ ID NO: 2744 - RNA, 19 nt, artificial
  Chemically synthesized
uggagagucacacagguaa

SEQ ID NO: 2745 - RNA, 19 nt, artificial
  Chemically synthesized
gagaaaaaagagauguuuc

SEQ ID NO: 2746 - RNA, 19 nt, artificial
  Chemically synthesized
ugugcuggauaaguucaaa

SEQ ID NO: 2747 - RNA, 19 nt, artificial
  Chemically synthesized
guucuccacccaguaggca

SEQ ID NO: 2748 - RNA, 19 nt, artificial
  Chemically synthesized
gugcuggauaaguucaaau

SEQ ID NO: 2749 - RNA, 19 nt, artificial
  Chemically synthesized
cauuccacggaacuuguaa

SEQ ID NO: 2750 - RNA, 19 nt, artificial
  Chemically synthesized
acaagacagagaagccuga

SEQ ID NO: 2751 - RNA, 19 nt, artificial
  Chemically synthesized
cgcagcuugcagaagcgcu

SEQ ID NO: 2752 - RNA, 19 nt, artificial
  Chemically synthesized
acaggagcaaaugaaguua

SEQ ID NO: 2753 - RNA, 19 nt, artificial
  Chemically synthesized
gaagccugauuggaggauu

SEQ ID NO: 2754 - RNA, 19 nt, artificial
  Chemically synthesized
gcagccuguuacacugugu

SEQ ID NO: 2755 - RNA, 19 nt, artificial
  Chemically synthesized
ggacuuuaucgcagcucuc

SEQ ID NO: 2756 - RNA, 19 nt, artificial
  Chemically synthesized
ucuuuucaauggagucaau

SEQ ID NO: 2757 - RNA, 19 nt, artificial
  Chemically synthesized
cagcuccuggaccauaagg

SEQ ID NO: 2758 - RNA, 19 nt, artificial
  Chemically synthesized
gcagcuugcagaagcgcug

SEQ ID NO: 2759 - RNA, 19 nt, artificial
  Chemically synthesized
gaaaugggagaaguccagu

SEQ ID NO: 2760 - RNA, 19 nt, artificial
  Chemically synthesized
ggaaugcagccuguuacac

SEQ ID NO: 2761 - RNA, 19 nt, artificial
  Chemically synthesized
aggaauucacaggagcaaa

SEQ ID NO: 2762 - RNA, 19 nt, artificial
  Chemically synthesized
ccaaacauuccacggaacu

SEQ ID NO: 2763 - RNA, 19 nt, artificial
  Chemically synthesized
caggcauccucacaggcug

SEQ ID NO: 2764 - RNA, 19 nt, artificial
  Chemically synthesized
cucaaugggcuccagaaga

SEQ ID NO: 2765 - RNA, 19 nt, artificial
  Chemically synthesized
agacccacaccauccacaa

SEQ ID NO: 2766 - RNA, 19 nt, artificial
  Chemically synthesized
ccucacaggcugaauuuuu

SEQ ID NO: 2767 - RNA, 19 nt, artificial
  Chemically synthesized
gcaaaugaaguuauugcca

SEQ ID NO: 2768 - RNA, 19 nt, artificial
  Chemically synthesized
cagcacaugccagacacca

SEQ ID NO: 2769 - RNA, 19 nt, artificial
  Chemically synthesized
ccagcaguaaaauaugcug

SEQ ID NO: 2770 - RNA, 19 nt, artificial
  Chemically synthesized
cuuuucuggccacugacaa

SEQ ID NO: 2771 - RNA, 19 nt, artificial
  Chemically synthesized
ugagggaauggaguuuaaa

SEQ ID NO: 2772 - RNA, 19 nt, artificial
  Chemically synthesized
ggauggagagucacacagg

SEQ ID NO: 2773 - RNA, 19 nt, artificial
  Chemically synthesized
uggccagugcuugcugcuc

SEQ ID NO: 2774 - RNA, 19 nt, artificial
  Chemically synthesized
gagcuuuccugggcuuccu

SEQ ID NO: 2775 - RNA, 19 nt, artificial
  Chemically synthesized
ggcucuuuucaauggaguc

SEQ ID NO: 2776 - RNA, 19 nt, artificial
  Chemically synthesized
ucucaaguuccucaaggaa

SEQ ID NO: 2777 - RNA, 19 nt, artificial
  Chemically synthesized
acauuccacggaacuugua

SEQ ID NO: 2778 - RNA, 19 nt, artificial
  Chemically synthesized
aacuuucaucggugauuuu

SEQ ID NO: 2779 - RNA, 19 nt, artificial
  Chemically synthesized
ggagucaaugauauuguca

SEQ ID NO: 2780 - RNA, 19 nt, artificial
  Chemically synthesized
cagguaggucuugguguuc

SEQ ID NO: 2781 - RNA, 19 nt, artificial
  Chemically synthesized
guugcggcaaauucaaaga

SEQ ID NO: 2782 - RNA, 19 nt, artificial
  Chemically synthesized
aacaaacuuucaucgguga

SEQ ID NO: 2783 - RNA, 19 nt, artificial
  Chemically synthesized
gacuuuaucgcagcucuca

SEQ ID NO: 2784 - RNA, 19 nt, artificial
  Chemically synthesized
cagagcacagcacaugcca

SEQ ID NO: 2785 - RNA, 19 nt, artificial
  Chemically synthesized
gcacaugccagacaccagu

SEQ ID NO: 2786 - RNA, 19 nt, artificial
  Chemically synthesized
gaagucccgcuuaugaaga

SEQ ID NO: 2787 - RNA, 19 nt, artificial
  Chemically synthesized
caaugggcuccagaagaau

SEQ ID NO: 2788 - RNA, 19 nt, artificial
  Chemically synthesized
uccucacaggcugaauuuu

SEQ ID NO: 2789 - RNA, 19 nt, artificial
  Chemically synthesized
cuguugcuaauguagguga

SEQ ID NO: 2790 - RNA, 19 nt, artificial
  Chemically synthesized
guccaugggccacuccagg

SEQ ID NO: 2791 - RNA, 19 nt, artificial
  Chemically synthesized
guuccaaacauuccacgga

SEQ ID NO: 2792 - RNA, 19 nt, artificial
  Chemically synthesized
ugggccacuccagguaggu

SEQ ID NO: 2793 - RNA, 19 nt, artificial
  Chemically synthesized
caaguugcuccuuagaaaa

SEQ ID NO: 2794 - RNA, 19 nt, artificial
  Chemically synthesized
cucacucuucacaaaguuu

SEQ ID NO: 2795 - RNA, 19 nt, artificial
  Chemically synthesized
agaagccugauuggaggau

SEQ ID NO: 2796 - RNA, 19 nt, artificial
  Chemically synthesized
aggcugaauuuuucaagua

SEQ ID NO: 2797 - RNA, 19 nt, artificial
  Chemically synthesized
ccaguucauacuugcacca

SEQ ID NO: 2798 - RNA, 19 nt, artificial
  Chemically synthesized
caggaaugaagucccgcuu

SEQ ID NO: 2799 - RNA, 19 nt, artificial
  Chemically synthesized
ggugauuuucacauuucua

SEQ ID NO: 2800 - RNA, 19 nt, artificial
  Chemically synthesized
cauucugaauugacuucaa

SEQ ID NO: 2801 - RNA, 19 nt, artificial
  Chemically synthesized
guuagucaaguuuuucaga

SEQ ID NO: 2802 - RNA, 19 nt, artificial
  Chemically synthesized
guaggucuugguguucauu

SEQ ID NO: 2803 - RNA, 19 nt, artificial
  Chemically synthesized
gguaauuugcuggccaauc

SEQ ID NO: 2804 - RNA, 19 nt, artificial
  Chemically synthesized
guucugaaaaauggaaagu

SEQ ID NO: 2805 - RNA, 19 nt, artificial
  Chemically synthesized
ccuggaucuauaacucugu

SEQ ID NO: 2806 - RNA, 19 nt, artificial
  Chemically synthesized
gacagagaagccugauugg

SEQ ID NO: 2807 - RNA, 19 nt, artificial
  Chemically synthesized
ucuccagcuccuggaccau

SEQ ID NO: 2808 - RNA, 19 nt, artificial
  Chemically synthesized
aguaaacaaggaaccagaa

SEQ ID NO: 2809 - RNA, 19 nt, artificial
  Chemically synthesized
gucaaugauccacuugcca

SEQ ID NO: 2810 - RNA, 19 nt, artificial
  Chemically synthesized
gagauccaaguauucuaau

SEQ ID NO: 2811 - RNA, 19 nt, artificial
  Chemically synthesized
gcaucccgcucacuguaag

SEQ ID NO: 2812 - RNA, 19 nt, artificial
  Chemically synthesized
caccacucacucuucacaa

SEQ ID NO: 2813 - RNA, 19 nt, artificial
  Chemically synthesized
agacaguuuuguggcucuu

SEQ ID NO: 2814 - RNA, 19 nt, artificial
  Chemically synthesized
ccuuuuggccuggagccag

SEQ ID NO: 2815 - RNA, 19 nt, artificial
  Chemically synthesized
cugcuccugagugaaggag

SEQ ID NO: 2816 - RNA, 19 nt, artificial
  Chemically synthesized
gcaucauuguucucaucaa

SEQ ID NO: 2817 - RNA, 19 nt, artificial
  Chemically synthesized
ggaucagcaggaacagagc

SEQ ID NO: 2818 - RNA, 19 nt, artificial
  Chemically synthesized
uggagccaggcccacauca

SEQ ID NO: 2819 - RNA, 19 nt, artificial
  Chemically synthesized
cuuuuggccuggagccagg

SEQ ID NO: 2820 - RNA, 19 nt, artificial
  Chemically synthesized
ggcaucugguagagucauc

SEQ ID NO: 2821 - RNA, 19 nt, artificial
  Chemically synthesized
cacucacucuucacaaagu

SEQ ID NO: 2822 - RNA, 19 nt, artificial
  Chemically synthesized
cuaaaauuuccagugucuu

SEQ ID NO: 2823 - RNA, 19 nt, artificial
  Chemically synthesized
ggaaacgguggcacaggac

SEQ ID NO: 2824 - RNA, 19 nt, artificial
  Chemically synthesized
guuuaaagauccugagcug

SEQ ID NO: 2825 - RNA, 19 nt, artificial
  Chemically synthesized
ggaauucacaggagcaaau

SEQ ID NO: 2826 - RNA, 19 nt, artificial
  Chemically synthesized
aguuuucagaaagcacaaa

SEQ ID NO: 2827 - RNA, 19 nt, artificial
  Chemically synthesized
augcagccuccggauuguu

SEQ ID NO: 2828 - RNA, 19 nt, artificial
  Chemically synthesized
aucgcagcucucagauuua

SEQ ID NO: 2829 - RNA, 19 nt, artificial
  Chemically synthesized
ccuuggagaggcugaugau

SEQ ID NO: 2830 - RNA, 19 nt, artificial
  Chemically synthesized
ggaauggcuuuuuucucaa

SEQ ID NO: 2831 - RNA, 19 nt, artificial
  Chemically synthesized
cagggaagaaaaagaaucu

SEQ ID NO: 2832 - RNA, 19 nt, artificial
  Chemically synthesized
caggagcaaaugaaguuau

SEQ ID NO: 2833 - RNA, 19 nt, artificial
  Chemically synthesized
agggaggcaucugguagag

SEQ ID NO: 2834 - RNA, 19 nt, artificial
  Chemically synthesized
caccagcuuccaaagucuu

SEQ ID NO: 2835 - RNA, 19 nt, artificial
  Chemically synthesized
ggaguuuaaagauccugag

SEQ ID NO: 2836 - RNA, 19 nt, artificial
  Chemically synthesized
ugccaccagcuuccaaagu

SEQ ID NO: 2837 - RNA, 19 nt, artificial
  Chemically synthesized
gcuuuccugggcuuccuuu

SEQ ID NO: 2838 - RNA, 19 nt, artificial
  Chemically synthesized
caaacauuccacggaacuu

SEQ ID NO: 2839 - RNA, 19 nt, artificial
  Chemically synthesized
aaggaaccagaaaaacuuu

SEQ ID NO: 2840 - RNA, 19 nt, artificial
  Chemically synthesized
caaaaagacggaaauggga

SEQ ID NO: 2841 - RNA, 19 nt, artificial
  Chemically synthesized
cuuuggccagugcuugcug

SEQ ID NO: 2842 - RNA, 19 nt, artificial
  Chemically synthesized
aguaggcaucccgcucacu

SEQ ID NO: 2843 - RNA, 19 nt, artificial
  Chemically synthesized
cacaggagcaaaugaaguu

SEQ ID NO: 2844 - RNA, 19 nt, artificial
  Chemically synthesized
caucugguagagucaucaa

SEQ ID NO: 2845 - RNA, 19 nt, artificial
  Chemically synthesized
caucccgcucacuguaaga

SEQ ID NO: 2846 - RNA, 19 nt, artificial
  Chemically synthesized
guuccucaaggaagguaag

SEQ ID NO: 2847 - RNA, 19 nt, artificial
  Chemically synthesized
caugggccacuccagguag

SEQ ID NO: 2848 - RNA, 19 nt, artificial
  Chemically synthesized
uguaaggauuucccaguaa

SEQ ID NO: 2849 - RNA, 19 nt, artificial
  Chemically synthesized
aggcaucugguagagucau

SEQ ID NO: 2850 - RNA, 19 nt, artificial
  Chemically synthesized
caagacagagaagccugau

SEQ ID NO: 2851 - RNA, 19 nt, artificial
  Chemically synthesized
aggaaugaagucccgcuua

SEQ ID NO: 2852 - RNA, 19 nt, artificial
  Chemically synthesized
cagcuugcagaagcgcugg

SEQ ID NO: 2853 - RNA, 19 nt, artificial
  Chemically synthesized
ggucacuguugcuaaugua

SEQ ID NO: 2854 - RNA, 19 nt, artificial
  Chemically synthesized
gaagaaaaagaaucuuccu

SEQ ID NO: 2855 - RNA, 19 nt, artificial
  Chemically synthesized
cacaggcugaauuuuucaa

SEQ ID NO: 2856 - RNA, 19 nt, artificial
  Chemically synthesized
gcaccacucacucuucaca

SEQ ID NO: 2857 - RNA, 19 nt, artificial
  Chemically synthesized
cuugggaaugcagccuguu

SEQ ID NO: 2858 - RNA, 19 nt, artificial
  Chemically synthesized
guuucaccaguggauaguu

SEQ ID NO: 2859 - RNA, 19 nt, artificial
  Chemically synthesized
guaaguccagcaaaaucuu

SEQ ID NO: 2860 - RNA, 19 nt, artificial
  Chemically synthesized
gcugcuucauaugaaggau

SEQ ID NO: 2861 - RNA, 19 nt, artificial
  Chemically synthesized
cuuccgcagcuugcagaag

SEQ ID NO: 2862 - RNA, 19 nt, artificial
  Chemically synthesized
gcuuccuuuuggccuggag

SEQ ID NO: 2863 - RNA, 19 nt, artificial
  Chemically synthesized
cgugugcuggauaaguuca

SEQ ID NO: 2864 - RNA, 19 nt, artificial
  Chemically synthesized
aagagggaggcaucuggua

SEQ ID NO: 2865 - RNA, 19 nt, artificial
  Chemically synthesized
caauggagucaaugauauu

SEQ ID NO: 2866 - RNA, 19 nt, artificial
  Chemically synthesized
gaggcaucugguagaguca

SEQ ID NO: 2867 - RNA, 19 nt, artificial
  Chemically synthesized
guuggacaggucaaggcuu

SEQ ID NO: 2868 - RNA, 19 nt, artificial
  Chemically synthesized
ggccagugcuugcugcucc

SEQ ID NO: 2869 - RNA, 19 nt, artificial
  Chemically synthesized
caucaaaaagacggaaaug

SEQ ID NO: 2870 - RNA, 19 nt, artificial
  Chemically synthesized
gcaauuuugugagaugaga

SEQ ID NO: 2871 - RNA, 19 nt, artificial
  Chemically synthesized
ccagguaggucuugguguu

SEQ ID NO: 2872 - RNA, 19 nt, artificial
  Chemically synthesized
ggaaccagaaaaacuuuac

SEQ ID NO: 2873 - RNA, 19 nt, artificial
  Chemically synthesized
gauggagagucacacaggu

SEQ ID NO: 2874 - RNA, 19 nt, artificial
  Chemically synthesized
ccacgcacaugggauggag

SEQ ID NO: 2875 - RNA, 19 nt, artificial
  Chemically synthesized
ccauuaaggguacagucau

SEQ ID NO: 2876 - RNA, 19 nt, artificial
  Chemically synthesized
guggauaguucugaaaaau

SEQ ID NO: 2877 - RNA, 19 nt, artificial
  Chemically synthesized
gaguuuaaagauccugagc

SEQ ID NO: 2878 - RNA, 19 nt, artificial
  Chemically synthesized
gcuuaugaagacacaacuu

SEQ ID NO: 2879 - RNA, 19 nt, artificial
  Chemically synthesized
cugguagagucaucaacuu

SEQ ID NO: 2880 - RNA, 19 nt, artificial
  Chemically synthesized
cacuuuaccuggaucuaua

SEQ ID NO: 2881 - RNA, 19 nt, artificial
  Chemically synthesized
cugggagcuuuccugggcu

SEQ ID NO: 2882 - RNA, 19 nt, artificial
  Chemically synthesized
gacaguuuuguggcucuuu

SEQ ID NO: 2883 - RNA, 19 nt, artificial
  Chemically synthesized
gugauccuguuguuggaca

SEQ ID NO: 2884 - RNA, 19 nt, artificial
  Chemically synthesized
gguaggucuugguguucau

SEQ ID NO: 2885 - RNA, 19 nt, artificial
  Chemically synthesized
cucuuuucaauggagucaa

SEQ ID NO: 2886 - RNA, 19 nt, artificial
  Chemically synthesized
guccagcaaaaucuuuucu

SEQ ID NO: 2887 - RNA, 19 nt, artificial
  Chemically synthesized
gagcacagcacaugccaga

SEQ ID NO: 2888 - RNA, 19 nt, artificial
  Chemically synthesized
caugggauggagagucaca

SEQ ID NO: 2889 - RNA, 19 nt, artificial
  Chemically synthesized
gggauggagagucacacag

SEQ ID NO: 2890 - RNA, 19 nt, artificial
  Chemically synthesized
gcuaauguaggugauccug

SEQ ID NO: 2891 - RNA, 19 nt, artificial
  Chemically synthesized
caacuccauuaaggguaca

SEQ ID NO: 2892 - RNA, 19 nt, artificial
  Chemically synthesized
augauccacuugccaggaa

SEQ ID NO: 2893 - RNA, 19 nt, artificial
  Chemically synthesized
gacuuuggccagugcuugc

SEQ ID NO: 2894 - RNA, 19 nt, artificial
  Chemically synthesized
ccaggcauccucacaggcu

SEQ ID NO: 2895 - RNA, 19 nt, artificial
  Chemically synthesized
gaucagcaggaacagagca

SEQ ID NO: 2896 - RNA, 19 nt, artificial
  Chemically synthesized
aggaagguaaguccagcaa

SEQ ID NO: 2897 - RNA, 19 nt, artificial
  Chemically synthesized
gcagccuccggauuguuaa

SEQ ID NO: 2898 - RNA, 19 nt, artificial
  Chemically synthesized
ccaguggauaguucugaaa

SEQ ID NO: 2899 - RNA, 19 nt, artificial
  Chemically synthesized
guaaacaaggaaccagaaa

SEQ ID NO: 2900 - RNA, 19 nt, artificial
  Chemically synthesized
accacucacucuucacaaa

SEQ ID NO: 2901 - RNA, 19 nt, artificial
  Chemically synthesized
gauccuguuguuggacagg

SEQ ID NO: 2902 - RNA, 19 nt, artificial
  Chemically synthesized
ccgcucacuguaagaaaca

SEQ ID NO: 2903 - RNA, 19 nt, artificial
  Chemically synthesized
guaaaauaugcugcuucau

SEQ ID NO: 2904 - RNA, 19 nt, artificial
  Chemically synthesized
ggugauccuguuguuggac

SEQ ID NO: 2905 - RNA, 19 nt, artificial
  Chemically synthesized
ccauuggaugucagcacca

SEQ ID NO: 2906 - RNA, 19 nt, artificial
  Chemically synthesized
cagaaagcacaaagacagu

SEQ ID NO: 2907 - RNA, 19 nt, artificial
  Chemically synthesized
uggacaggucaaggcuuuu

SEQ ID NO: 2908 - RNA, 19 nt, artificial
  Chemically synthesized
ggaucagaugacuuacauu

SEQ ID NO: 2909 - RNA, 19 nt, artificial
  Chemically synthesized
cugcccagggaagaaaaag

SEQ ID NO: 2910 - RNA, 19 nt, artificial
  Chemically synthesized
aggugauccuguuguugga

SEQ ID NO: 2911 - RNA, 19 nt, artificial
  Chemically synthesized
guaggucacuguugcuaau

SEQ ID NO: 2912 - RNA, 19 nt, artificial
  Chemically synthesized
cgagaggcggacauccuga

SEQ ID NO: 2913 - RNA, 19 nt, artificial
  Chemically synthesized
aucuuccucuauuguguua

SEQ ID NO: 2914 - RNA, 19 nt, artificial
  Chemically synthesized
cuuuaccuggaucuauaac

SEQ ID NO: 2915 - RNA, 19 nt, artificial
  Chemically synthesized
ccuggaccauaagguucuc

SEQ ID NO: 2916 - RNA, 19 nt, artificial
  Chemically synthesized
cuccacccaguaggcaucc

SEQ ID NO: 2917 - RNA, 19 nt, artificial
  Chemically synthesized
gcuucauaugaaggaucag

SEQ ID NO: 2918 - RNA, 19 nt, artificial
  Chemically synthesized
cuggccacgcacaugggau

SEQ ID NO: 2919 - RNA, 19 nt, artificial
  Chemically synthesized
caucggugauuuucacauu

SEQ ID NO: 2920 - RNA, 19 nt, artificial
  Chemically synthesized
guguauucgugugcuggau

SEQ ID NO: 2921 - RNA, 19 nt, artificial
  Chemically synthesized
aggcaucccgcucacugua

SEQ ID NO: 2922 - RNA, 19 nt, artificial
  Chemically synthesized
gacuuacauucugaauuga

SEQ ID NO: 2923 - RNA, 19 nt, artificial
  Chemically synthesized
aggagcaaaugaaguuauu

SEQ ID NO: 2924 - RNA, 19 nt, artificial
  Chemically synthesized
caguggauaguucugaaaa

SEQ ID NO: 2925 - RNA, 19 nt, artificial
  Chemically synthesized
aguggauaguucugaaaaa

SEQ ID NO: 2926 - RNA, 19 nt, artificial
  Chemically synthesized
gugagcaggaucagcagga

SEQ ID NO: 2927 - RNA, 19 nt, artificial
  Chemically synthesized
caucaacuuauuucuggaa

SEQ ID NO: 2928 - RNA, 19 nt, artificial
  Chemically synthesized
ggcucauagcucuguagau

SEQ ID NO: 2929 - RNA, 19 nt, artificial
  Chemically synthesized
gaucuauaacucugucauu

SEQ ID NO: 2930 - RNA, 19 nt, artificial
  Chemically synthesized
uccacuuuaccuggaucua

SEQ ID NO: 2931 - RNA, 19 nt, artificial
  Chemically synthesized
agccaggcccacaucauuu

SEQ ID NO: 2932 - RNA, 19 nt, artificial
  Chemically synthesized
uggccuggagccaggccca

SEQ ID NO: 2933 - RNA, 19 nt, artificial
  Chemically synthesized
gcaggaacagagcacagca

SEQ ID NO: 2934 - RNA, 19 nt, artificial
  Chemically synthesized
gagagggccaggcauccuc

SEQ ID NO: 2935 - RNA, 19 nt, artificial
  Chemically synthesized
ggauuucccaguaaguuua

SEQ ID NO: 2936 - RNA, 19 nt, artificial
  Chemically synthesized
ggaaugaagucccgcuuau

SEQ ID NO: 2937 - RNA, 19 nt, artificial
  Chemically synthesized
aggcccacaucauuuucau

SEQ ID NO: 2938 - RNA, 19 nt, artificial
  Chemically synthesized
cagcaggaacagagcacag

SEQ ID NO: 2939 - RNA, 19 nt, artificial
  Chemically synthesized
ccagcaaaaucuuuucuuu

SEQ ID NO: 2940 - RNA, 19 nt, artificial
  Chemically synthesized
gaauggcagcaucauuguu

SEQ ID NO: 2941 - RNA, 19 nt, artificial
  Chemically synthesized
caguaggcaucccgcucac

SEQ ID NO: 2942 - RNA, 19 nt, artificial
  Chemically synthesized
caaaaaucuccagcaguaa

SEQ ID NO: 2943 - RNA, 19 nt, artificial
  Chemically synthesized
gaaccagaaaaacuuuacu

SEQ ID NO: 2944 - RNA, 19 nt, artificial
  Chemically synthesized
cucaucaaaaagacggaaa

SEQ ID NO: 2945 - RNA, 19 nt, artificial
  Chemically synthesized
guucuuugaguugcggcaa

SEQ ID NO: 2946 - RNA, 19 nt, artificial
  Chemically synthesized
cuuugaguugcggcaaauu

SEQ ID NO: 2947 - RNA, 19 nt, artificial
  Chemically synthesized
cagugcuugcugcuccuga

SEQ ID NO: 2948 - RNA, 19 nt, artificial
  Chemically synthesized
ccaagacccacaccaucca

SEQ ID NO: 2949 - RNA, 19 nt, artificial
  Chemically synthesized
ccuguuguuggacagguca

SEQ ID NO: 2950 - RNA, 19 nt, artificial
  Chemically synthesized
gcuggauaaguucaaauau

SEQ ID NO: 2951 - RNA, 19 nt, artificial
  Chemically synthesized
gccugauuggaggauucuu

SEQ ID NO: 2952 - RNA, 19 nt, artificial
  Chemically synthesized
gcucuuuucaauggaguca

SEQ ID NO: 2953 - RNA, 19 nt, artificial
  Chemically synthesized
cggucacaagacagagaag

SEQ ID NO: 2954 - RNA, 19 nt, artificial
  Chemically synthesized
gguaagagggaggcaucug

SEQ ID NO: 2955 - RNA, 19 nt, artificial
  Chemically synthesized
cacgcacaugggauggaga

SEQ ID NO: 2956 - RNA, 19 nt, artificial
  Chemically synthesized
ccagcuccuggaccauaag

SEQ ID NO: 2957 - RNA, 19 nt, artificial
  Chemically synthesized
gagcaggaucagcaggaac

SEQ ID NO: 2958 - RNA, 19 nt, artificial
  Chemically synthesized
agggaagaaaaagaaucuu

SEQ ID NO: 2959 - RNA, 19 nt, artificial
  Chemically synthesized
cuugcugcuccugagugaa

SEQ ID NO: 2960 - RNA, 19 nt, artificial
  Chemically synthesized
gggaauggaguuuaaagau

SEQ ID NO: 2961 - RNA, 19 nt, artificial
  Chemically synthesized
ugggagcuuuccugggcuu

SEQ ID NO: 2962 - RNA, 19 nt, artificial
  Chemically synthesized
caggcccacaucauuuuca

SEQ ID NO: 2963 - RNA, 19 nt, artificial
  Chemically synthesized
ccacuccagguaggucuug

SEQ ID NO: 2964 - RNA, 19 nt, artificial
  Chemically synthesized
guaacauggguaagaggga

SEQ ID NO: 2965 - RNA, 19 nt, artificial
  Chemically synthesized
caaguuccucaaggaaggu

SEQ ID NO: 2966 - RNA, 19 nt, artificial
  Chemically synthesized
agagagggccaggcauccu

SEQ ID NO: 2967 - RNA, 19 nt, artificial
  Chemically synthesized
caucuaaaauuuccagugu

SEQ ID NO: 2968 - RNA, 19 nt, artificial
  Chemically synthesized
guuuccacuuuaccuggau

SEQ ID NO: 2969 - RNA, 19 nt, artificial
  Chemically synthesized
cacaugggauggagaguca

SEQ ID NO: 2970 - RNA, 19 nt, artificial
  Chemically synthesized
cuuccucuauuguguuaau

SEQ ID NO: 2971 - RNA, 19 nt, artificial
  Chemically synthesized
gaagguaaguccagcaaaa

SEQ ID NO: 2972 - RNA, 19 nt, artificial
  Chemically synthesized
ggaagguaaguccagcaaa

SEQ ID NO: 2973 - RNA, 19 nt, artificial
  Chemically synthesized
acuuuaccuggaucuauaa

SEQ ID NO: 2974 - RNA, 19 nt, artificial
  Chemically synthesized
caguaucucgcaguuccaa

SEQ ID NO: 2975 - RNA, 19 nt, artificial
  Chemically synthesized
gcuccuggaccauaagguu

SEQ ID NO: 2976 - RNA, 19 nt, artificial
  Chemically synthesized
agagggccaggcauccuca

SEQ ID NO: 2977 - RNA, 19 nt, artificial
  Chemically synthesized
gugugcuggauaaguucaa

SEQ ID NO: 2978 - RNA, 19 nt, artificial
  Chemically synthesized
gagggaggcaucugguaga

SEQ ID NO: 2979 - RNA, 19 nt, artificial
  Chemically synthesized
aggaaccagaaaaacuuua

SEQ ID NO: 2980 - RNA, 19 nt, artificial
  Chemically synthesized
gcacagcacaugccagaca

SEQ ID NO: 2981 - RNA, 19 nt, artificial
  Chemically synthesized
caccauccacaaaguaugu

SEQ ID NO: 2982 - RNA, 19 nt, artificial
  Chemically synthesized
cauggguaagagggaggca

SEQ ID NO: 2983 - RNA, 19 nt, artificial
  Chemically synthesized
gagaagccugauuggagga

SEQ ID NO: 2984 - RNA, 19 nt, artificial
  Chemically synthesized
guauucgugugcuggauaa

SEQ ID NO: 2985 - RNA, 19 nt, artificial
  Chemically synthesized
ccgcagcuugcagaagcgc

SEQ ID NO: 2986 - RNA, 19 nt, artificial
  Chemically synthesized
ggcugaauuuuucaaguau

SEQ ID NO: 2987 - RNA, 19 nt, artificial
  Chemically synthesized
cccaguaggcaucccgcuc

SEQ ID NO: 2988 - RNA, 19 nt, artificial
  Chemically synthesized
ugagcaggaucagcaggaa

SEQ ID NO: 2989 - RNA, 19 nt, artificial
  Chemically synthesized
gcauccucacaggcugaau

SEQ ID NO: 2990 - RNA, 19 nt, artificial
  Chemically synthesized
ggacaggucaaggcuuuuu

SEQ ID NO: 2991 - RNA, 19 nt, artificial
  Chemically synthesized
agggccaggcauccucaca

SEQ ID NO: 2992 - RNA, 19 nt, artificial
  Chemically synthesized
gggaaugcagccuguuaca

SEQ ID NO: 2993 - RNA, 19 nt, artificial
  Chemically synthesized
ccacuuuaccuggaucuau

SEQ ID NO: 2994 - RNA, 19 nt, artificial
  Chemically synthesized
gugcuugcugcuccugagu

SEQ ID NO: 2995 - RNA, 19 nt, artificial
  Chemically synthesized
gaggaauucacaggagcaa

SEQ ID NO: 2996 - RNA, 19 nt, artificial
  Chemically synthesized
ggaacagagcacagcacau

SEQ ID NO: 2997 - RNA, 19 nt, artificial
  Chemically synthesized
agguaauuugcuggccaau

SEQ ID NO: 2998 - RNA, 19 nt, artificial
  Chemically synthesized
gggagcuuuccugggcuuc

SEQ ID NO: 2999 - RNA, 19 nt, artificial
  Chemically synthesized
gggagaaguccaguucaua

SEQ ID NO: 3000 - RNA, 19 nt, artificial
  Chemically synthesized
gagagucacacagguaauu

SEQ ID NO: 3001 - RNA, 19 nt, artificial
  Chemically synthesized
cccgcuuaugaagacacaa

SEQ ID NO: 3002 - RNA, 19 nt, artificial
  Chemically synthesized
gcaggaucagcaggaacag

SEQ ID NO: 3003 - RNA, 19 nt, artificial
  Chemically synthesized
gggccacuccagguagguc

SEQ ID NO: 3004 - RNA, 19 nt, artificial
  Chemically synthesized
ccacaaaguauguggcauu

SEQ ID NO: 3005 - RNA, 19 nt, artificial
  Chemically synthesized
gccaggcauccucacaggc

SEQ ID NO: 3006 - RNA, 19 nt, artificial
  Chemically synthesized
cugacaaguuucaggcaua

SEQ ID NO: 3007 - RNA, 19 nt, artificial
  Chemically synthesized
cgcucacuguaagaaacaa

SEQ ID NO: 3008 - RNA, 19 nt, artificial
  Chemically synthesized
cuggagccaggcccacauc

SEQ ID NO: 3009 - RNA, 19 nt, artificial
  Chemically synthesized
gagaggcggacauccugaa

SEQ ID NO: 3010 - RNA, 19 nt, artificial
  Chemically synthesized
gggccaggcauccucacag

SEQ ID NO: 3011 - RNA, 19 nt, artificial
  Chemically synthesized
ccaguaggcaucccgcuca

SEQ ID NO: 3012 - RNA, 19 nt, artificial
  Chemically synthesized
gcucucagauuuacccaaa

SEQ ID NO: 3013 - RNA, 19 nt, artificial
  Chemically synthesized
ccugagggaauggaguuua

SEQ ID NO: 3014 - RNA, 19 nt, artificial
  Chemically synthesized
ggagagucacacagguaau

SEQ ID NO: 3015 - RNA, 19 nt, artificial
  Chemically synthesized
aggcauccucacaggcuga

SEQ ID NO: 3016 - RNA, 19 nt, artificial
  Chemically synthesized
gaaaaagaaucuuccucua

SEQ ID NO: 3017 - RNA, 19 nt, artificial
  Chemically synthesized
cgcacaugggauggagagu

SEQ ID NO: 3018 - RNA, 19 nt, artificial
  Chemically synthesized
gaguugcggcaaauucaaa

SEQ ID NO: 3019 - RNA, 19 nt, artificial
  Chemically synthesized
acugcccagggaagaaaaa

SEQ ID NO: 3020 - RNA, 19 nt, artificial
  Chemically synthesized
cccacaccauccacaaagu

SEQ ID NO: 3021 - RNA, 19 nt, artificial
  Chemically synthesized
cuguuguuggacaggucaa

SEQ ID NO: 3022 - RNA, 19 nt, artificial
  Chemically synthesized
ggagccaggcccacaucau

SEQ ID NO: 3023 - RNA, 19 nt, artificial
  Chemically synthesized
gggcuuccuuuuggccugg

SEQ ID NO: 3024 - RNA, 19 nt, artificial
  Chemically synthesized
gcuugcugcuccugaguga

SEQ ID NO: 3025 - RNA, 19 nt, artificial
  Chemically synthesized
gccacuccagguaggucuu

SEQ ID NO: 3026 - RNA, 19 nt, artificial
  Chemically synthesized
ccaugggccacuccaggua

SEQ ID NO: 3027 - RNA, 19 nt, artificial
  Chemically synthesized
ccacaccauccacaaagua

SEQ ID NO: 3028 - RNA, 19 nt, artificial
  Chemically synthesized
ccagugcuugcugcuccug

SEQ ID NO: 3029 - RNA, 19 nt, artificial
  Chemically synthesized
gccagugcuugcugcuccu

SEQ ID NO: 3030 - RNA, 19 nt, artificial
  Chemically synthesized
caggaucagcaggaacaga

SEQ ID NO: 3031 - RNA, 19 nt, artificial
  Chemically synthesized
gggaggcaucugguagagu

SEQ ID NO: 3032 - RNA, 19 nt, artificial
  Chemically synthesized
ccaggcccacaucauuuuc

SEQ ID NO: 3033 - RNA, 19 nt, artificial
  Chemically synthesized
ccuggagccaggcccacau

SEQ ID NO: 3034 - RNA, 19 nt, artificial
  Chemically synthesized
ccagaaaaacuuuacuguu

SEQ ID NO: 3035 - RNA, 19 nt, artificial
  Chemically synthesized
gcugcuccugagugaagga

SEQ ID NO: 3036 - RNA, 19 nt, artificial
  Chemically synthesized
cuccagcuccuggaccaua

SEQ ID NO: 3037 - RNA, 19 nt, artificial
  Chemically synthesized
gagggccaggcauccucac

SEQ ID NO: 3038 - RNA, 19 nt, artificial
  Chemically synthesized
cguuuccacuuuaccugga

SEQ ID NO: 3039 - RNA, 19 nt, artificial
  Chemically synthesized
ggguaagagggaggcaucu

SEQ ID NO: 3040 - RNA, 19 nt, artificial
  Chemically synthesized
gcaguaaaauaugcugcuu

SEQ ID NO: 3041 - RNA, 19 nt, artificial
  Chemically synthesized
ggccacgcacaugggaugg

SEQ ID NO: 3042 - RNA, 19 nt, artificial
  Chemically synthesized
gagccaggcccacaucauu

SEQ ID NO: 3043 - RNA, 19 nt, artificial
  Chemically synthesized
cucucagauuuacccaaaa

SEQ ID NO: 3044 - RNA, 19 nt, artificial
  Chemically synthesized
gcggcaaauucaaagaaaa

SEQ ID NO: 3045 - RNA, 19 nt, artificial
  Chemically synthesized
cccagggaagaaaaagaau

SEQ ID NO: 3046 - RNA, 19 nt, artificial
  Chemically synthesized
gauuucccaguaaguuuaa

SEQ ID NO: 3047 - RNA, 19 nt, artificial
  Chemically synthesized
cagguaauuugcuggccaa

SEQ ID NO: 3048 - RNA, 19 nt, artificial
  Chemically synthesized
cggcaaauucaaagaaaau

SEQ ID NO: 3049 - RNA, 19 nt, artificial
  Chemically synthesized
gcccagggaagaaaaagaa

SEQ ID NO: 3050 - RNA, 19 nt, artificial
  Chemically synthesized
ggccaggcauccucacagg

SEQ ID NO: 3051 - RNA, 19 nt, artificial
  Chemically synthesized
gccacgcacaugggaugga

SEQ ID NO: 3052 - RNA, 19 nt, artificial
  Chemically synthesized
cugagggaauggaguuuaa

SEQ ID NO: 3053 - RNA, 19 nt, artificial
  Chemically synthesized
ggcuuccuuuuggccugga

SEQ ID NO: 3054 - RNA, 19 nt, artificial
  Chemically synthesized
gccuggagccaggcccaca

SEQ ID NO: 3055 - RNA, 19 nt, artificial
  Chemically synthesized
gccaggcccacaucauuuu

SEQ ID NO: 3056 - RNA, 19 nt, artificial
  Chemically synthesized
gacccacaccauccacaaa

SEQ ID NO: 3057 - RNA, 19 nt, artificial
  Chemically synthesized
gcuggccacgcacauggga

SEQ ID NO: 3058 - RNA, 19 nt, artificial
  Chemically synthesized
ggcaucccgcucacuguaa

SEQ ID NO: 3059 - RNA, 19 nt, artificial
  Chemically synthesized
ggcccacaucauuuucaua

SEQ ID NO: 3060 - RNA, 19 nt, Artificial Sequence
  Chemically synthesized
ggcauccucacaggcugaa

SEQ ID NO: 3061 - RNA, 18 nt, artificial
  Chemically synthesized
ggaucucagugaaaauuu

SEQ ID NO: 3062 - RNA, 18 nt, artificial
  Chemically synthesized
gggucaucaucagccucu

SEQ ID NO: 3063 - RNA, 18 nt, artificial
  Chemically synthesized
ggacuucauuccuggcaa

SEQ ID NO: 3064 - RNA, 18 nt, artificial
  Chemically synthesized
ggcccucucuacaaacuu

SEQ ID NO: 3065 - RNA, 18 nt, artificial
  Chemically synthesized
ccaagacacuggaaauuu

SEQ ID NO: 3066 - RNA, 18 nt, artificial
  Chemically synthesized
ccuuguuuacuuucacaa

SEQ ID NO: 3067 - RNA, 18 nt, artificial
  Chemically synthesized
ggagcaacuugacucauu

SEQ ID NO: 3068 - RNA, 18 nt, artificial
  Chemically synthesized
gaaucacaguagaaaaca

SEQ ID NO: 3069 - RNA, 18 nt, artificial
  Chemically synthesized
gccucuccaaggaagaau

SEQ ID NO: 3070 - RNA, 18 nt, artificial
  Chemically synthesized
gucuaguugggaucuuua

SEQ ID NO: 3071 - RNA, 18 nt, artificial
  Chemically synthesized
ggcucagcgggaaggauu

SEQ ID NO: 3072 - RNA, 18 nt, artificial
  Chemically synthesized
ggagauuuuuguagaugu

SEQ ID NO: 3073 - RNA, 18 nt, artificial
  Chemically synthesized
ggauccaaaggagaccua

SEQ ID NO: 3074 - RNA, 18 nt, artificial
  Chemically synthesized
ggcugcauucccaagaca

SEQ ID NO: 3075 - RNA, 18 nt, artificial
  Chemically synthesized
gcaacaaggcaaaguauu

SEQ ID NO: 3076 - RNA, 18 nt, artificial
  Chemically synthesized
gcugcauauuccaagguu

SEQ ID NO: 3077 - RNA, 18 nt, artificial
  Chemically synthesized
gcauuuguuucuuacagu

SEQ ID NO: 3078 - RNA, 18 nt, artificial
  Chemically synthesized
guugaugacucuaccaga

SEQ ID NO: 3079 - RNA, 18 nt, artificial
  Chemically synthesized
ggaagaauccuccaauca

SEQ ID NO: 3080 - RNA, 18 nt, artificial
  Chemically synthesized
ggaaaaaaccggagagac

SEQ ID NO: 3081 - RNA, 18 nt, artificial
  Chemically synthesized
ggaucuuuaugucacuag

SEQ ID NO: 3082 - RNA, 18 nt, artificial
  Chemically synthesized
gaccagucuuugucuagu

SEQ ID NO: 3083 - RNA, 18 nt, artificial
  Chemically synthesized
ccgucuuuuugaugagaa

SEQ ID NO: 3084 - RNA, 18 nt, artificial
  Chemically synthesized
ccaugaucauaagucuau

SEQ ID NO: 3085 - RNA, 18 nt, artificial
  Chemically synthesized
ggaucuuuaaacuccauu

SEQ ID NO: 3086 - RNA, 18 nt, artificial
  Chemically synthesized
ggaguucucccaguguuu

SEQ ID NO: 3087 - RNA, 18 nt, artificial
  Chemically synthesized
caguguuugguguugcaa

SEQ ID NO: 3088 - RNA, 18 nt, artificial
  Chemically synthesized
cagucuuugucuaguugg

SEQ ID NO: 3089 - RNA, 18 nt, artificial
  Chemically synthesized
gguggagaaccuuauggu

SEQ ID NO: 3090 - RNA, 18 nt, artificial
  Chemically synthesized
gggaauugguugcaggau

SEQ ID NO: 3091 - RNA, 18 nt, artificial
  Chemically synthesized
cggaguucucccaguguu

SEQ ID NO: 3092 - RNA, 18 nt, artificial
  Chemically synthesized
agugaguggugcaaguau

SEQ ID NO: 3093 - RNA, 18 nt, artificial
  Chemically synthesized
gguaguuguggguugaag

SEQ ID NO: 3094 - RNA, 18 nt, artificial
  Chemically synthesized
gccugaaacuugucagug

SEQ ID NO: 3095 - RNA, 18 nt, artificial
  Chemically synthesized
gcaacaacaaucucaauu

SEQ ID NO: 3096 - RNA, 18 nt, artificial
  Chemically synthesized
ggaucauugacaauauca

SEQ ID NO: 3097 - RNA, 18 nt, artificial
  Chemically synthesized
gaauguaagucaucugau

SEQ ID NO: 3098 - RNA, 18 nt, artificial
  Chemically synthesized
ggagcuggagaacuucaa

SEQ ID NO: 3099 - RNA, 18 nt, artificial
  Chemically synthesized
ggcagucuugaacauuua

SEQ ID NO: 3100 - RNA, 18 nt, artificial
  Chemically synthesized
ggagagacuuugcucacu

SEQ ID NO: 3101 - RNA, 18 nt, artificial
  Chemically synthesized
aguggaucauugacaaua

SEQ ID NO: 3102 - RNA, 18 nt, artificial
  Chemically synthesized
ggauguaccgucauuuga

SEQ ID NO: 3103 - RNA, 18 nt, artificial
  Chemically synthesized
ccuuaauggaguugguaa

SEQ ID NO: 3104 - RNA, 18 nt, artificial
  Chemically synthesized
ggcaaaaucauuuggcau

SEQ ID NO: 3105 - RNA, 18 nt, artificial
  Chemically synthesized
caaugacugugucauucu

SEQ ID NO: 3106 - RNA, 18 nt, artificial
  Chemically synthesized
gucuuugucuaguuggga

SEQ ID NO: 3107 - RNA, 18 nt, artificial
  Chemically synthesized
gagcccauugagaaaaaa

SEQ ID NO: 3108 - RNA, 18 nt, artificial
  Chemically synthesized
gggaaauccuuacaaaac

SEQ ID NO: 3109 - RNA, 18 nt, artificial
  Chemically synthesized
ccaaagucuugauugauu

SEQ ID NO: 3110 - RNA, 18 nt, artificial
  Chemically synthesized
gaagaauccuccaaucag

SEQ ID NO: 3111 - RNA, 18 nt, artificial
  Chemically synthesized
ccuucacuaagauucaaa

SEQ ID NO: 3112 - RNA, 18 nt, artificial
  Chemically synthesized
cauauuuaagaccagucu

SEQ ID NO: 3113 - RNA, 18 nt, artificial
  Chemically synthesized
ggagaaccuuauggucca

SEQ ID NO: 3114 - RNA, 18 nt, artificial
  Chemically synthesized
gcgagauacugauuugga

SEQ ID NO: 3115 - RNA, 18 nt, artificial
  Chemically synthesized
gccucucggugucggaau

SEQ ID NO: 3116 - RNA, 18 nt, artificial
  Chemically synthesized
cacaguugguugacuuca

SEQ ID NO: 3117 - RNA, 18 nt, artificial
  Chemically synthesized
gcccauugcucuuucacu

SEQ ID NO: 3118 - RNA, 18 nt, artificial
  Chemically synthesized
cuuggaucucagugaaaa

SEQ ID NO: 3119 - RNA, 18 nt, artificial
  Chemically synthesized
ccacaaaaggcauucucu

SEQ ID NO: 3120 - RNA, 18 nt, artificial
  Chemically synthesized
guuccuuguuuacuuuca

SEQ ID NO: 3121 - RNA, 18 nt, artificial
  Chemically synthesized
cuuugugcuuucugaaaa

SEQ ID NO: 3122 - RNA, 18 nt, artificial
  Chemically synthesized
caaugaugcugccauucu

SEQ ID NO: 3123 - RNA, 18 nt, artificial
  Chemically synthesized
cauucucuguccuaccua

SEQ ID NO: 3124 - RNA, 18 nt, artificial
  Chemically synthesized
gaguggugcaaguaugaa

SEQ ID NO: 3125 - RNA, 18 nt, artificial
  Chemically synthesized
ggaacugcgagauacuga

SEQ ID NO: 3126 - RNA, 18 nt, artificial
  Chemically synthesized
cagucuugaacauuuaga

SEQ ID NO: 3127 - RNA, 18 nt, artificial
  Chemically synthesized
ggguaaaucugagagcug

SEQ ID NO: 3128 - RNA, 18 nt, artificial
  Chemically synthesized
ggacuuaccuuccuugag

SEQ ID NO: 3129 - RNA, 18 nt, artificial
  Chemically synthesized
cccaaaacuuguugcuau

SEQ ID NO: 3130 - RNA, 18 nt, artificial
  Chemically synthesized
ggacuugcuuacuaaaac

SEQ ID NO: 3131 - RNA, 18 nt, artificial
  Chemically synthesized
guuuggaacugcgagaua

SEQ ID NO: 3132 - RNA, 18 nt, artificial
  Chemically synthesized
cugaaaacuuugugaaga

SEQ ID NO: 3133 - RNA, 18 nt, artificial
  Chemically synthesized
cugcauauuccaagguuu

SEQ ID NO: 3134 - RNA, 18 nt, artificial
  Chemically synthesized
ugcggaagauaaugaaca

SEQ ID NO: 3135 - RNA, 18 nt, artificial
  Chemically synthesized
ggguggagaaccuuaugg

SEQ ID NO: 3136 - RNA, 18 nt, artificial
  Chemically synthesized
gcucggaguucucccagu

SEQ ID NO: 3137 - RNA, 18 nt, artificial
  Chemically synthesized
ggcucauugugcccauug

SEQ ID NO: 3138 - RNA, 18 nt, artificial
  Chemically synthesized
ggcugcauauuccaaggu

SEQ ID NO: 3139 - RNA, 18 nt, artificial
  Chemically synthesized
ccgcaaugguaucugcaa

SEQ ID NO: 3140 - RNA, 18 nt, artificial
  Chemically synthesized
cugcuaagagacuccucu

SEQ ID NO: 3141 - RNA, 18 nt, artificial
  Chemically synthesized
gaaucagauuucuggauu

SEQ ID NO: 3142 - RNA, 18 nt, artificial
  Chemically synthesized
agaaaaaagugcugugua

SEQ ID NO: 3143 - RNA, 18 nt, artificial
  Chemically synthesized
ccaauggaauuaacacaa

SEQ ID NO: 3144 - RNA, 18 nt, artificial
  Chemically synthesized
gaugguugaagaauacuu

SEQ ID NO: 3145 - RNA, 18 nt, artificial
  Chemically synthesized
ggaguugguaauuuuaga

SEQ ID NO: 3146 - RNA, 18 nt, artificial
  Chemically synthesized
gcaacagugaccuacaga

SEQ ID NO: 3147 - RNA, 18 nt, artificial
  Chemically synthesized
ccugagagugggaaauau

SEQ ID NO: 3148 - RNA, 18 nt, artificial
  Chemically synthesized
gugacugcucggaguucu

SEQ ID NO: 3149 - RNA, 18 nt, artificial
  Chemically synthesized
gugaauuccucuccuuca

SEQ ID NO: 3150 - RNA, 18 nt, artificial
  Chemically synthesized
gccaaagucuugauugau

SEQ ID NO: 3151 - RNA, 18 nt, artificial
  Chemically synthesized
gaacaaugaugcugccau

SEQ ID NO: 3152 - RNA, 18 nt, artificial
  Chemically synthesized
cacugaagacuuuggaag

SEQ ID NO: 3153 - RNA, 18 nt, artificial
  Chemically synthesized
cccauauuuaagaccagu

SEQ ID NO: 3154 - RNA, 18 nt, artificial
  Chemically synthesized
gcaacucaaagaacuuua

SEQ ID NO: 3155 - RNA, 18 nt, artificial
  Chemically synthesized
gguugaagcacuggacaa

SEQ ID NO: 3156 - RNA, 18 nt, artificial
  Chemically synthesized
cuaugagccaaaaaguuu

SEQ ID NO: 3157 - RNA, 18 nt, artificial
  Chemically synthesized
ugagauugaugcuucaga

SEQ ID NO: 3158 - RNA, 18 nt, artificial
  Chemically synthesized
gcaacuugacucauuuca

SEQ ID NO: 3159 - RNA, 18 nt, artificial
  Chemically synthesized
agagcuaugagccaaaaa

SEQ ID NO: 3160 - RNA, 18 nt, artificial
  Chemically synthesized
gagcaacaaggcaaagua

SEQ ID NO: 3161 - RNA, 18 nt, artificial
  Chemically synthesized
guggcaauaacuucauuu

SEQ ID NO: 3162 - RNA, 18 nt, artificial
  Chemically synthesized
ggugacugcucggaguuc

SEQ ID NO: 3163 - RNA, 18 nt, artificial
  Chemically synthesized
aguaugaacuggacuucu

SEQ ID NO: 3164 - RNA, 18 nt, artificial
  Chemically synthesized
ggacaaugccacauacuu

SEQ ID NO: 3165 - RNA, 18 nt, artificial
  Chemically synthesized
gccagaaaagaugaaaua

SEQ ID NO: 3166 - RNA, 18 nt, artificial
  Chemically synthesized
gugcuuucugaaaacuuu

SEQ ID NO: 3167 - RNA, 18 nt, artificial
  Chemically synthesized
ggccaacuguaaucugua

SEQ ID NO: 3168 - RNA, 18 nt, artificial
  Chemically synthesized
ggaacuugagauugaugc

SEQ ID NO: 3169 - RNA, 18 nt, artificial
  Chemically synthesized
guccuagguucccauauu

SEQ ID NO: 3170 - RNA, 18 nt, artificial
  Chemically synthesized
gcuggagauuuuuguaga

SEQ ID NO: 3171 - RNA, 18 nt, artificial
  Chemically synthesized
gccgcaacucaaagaacu

SEQ ID NO: 3172 - RNA, 18 nt, artificial
  Chemically synthesized
ugggcagucuugaacauu

SEQ ID NO: 3173 - RNA, 18 nt, artificial
  Chemically synthesized
gaauuagaguuugaugac

SEQ ID NO: 3174 - RNA, 18 nt, artificial
  Chemically synthesized
agcccauugagaaaaaag

SEQ ID NO: 3175 - RNA, 18 nt, artificial
  Chemically synthesized
ccagucuuugucuaguug

SEQ ID NO: 3176 - RNA, 18 nt, artificial
  Chemically synthesized
cccuucaaguugugucuu

SEQ ID NO: 3177 - RNA, 18 nt, artificial
  Chemically synthesized
ccauugagaaaaaagcca

SEQ ID NO: 3178 - RNA, 18 nt, artificial
  Chemically synthesized
ggaauugguugcaggauc

SEQ ID NO: 3179 - RNA, 18 nt, artificial
  Chemically synthesized
ugugcuuucugaaaacuu

SEQ ID NO: 3180 - RNA, 18 nt, artificial
  Chemically synthesized
gagagacuuugcucacuc

SEQ ID NO: 3181 - RNA, 18 nt, artificial
  Chemically synthesized
agcucuuagugaccaagu

SEQ ID NO: 3182 - RNA, 18 nt, artificial
  Chemically synthesized
ccaagaccuaccuggagu

SEQ ID NO: 3183 - RNA, 18 nt, artificial
  Chemically synthesized
uggcaucauuggaaaaaa

SEQ ID NO: 3184 - RNA, 18 nt, artificial
  Chemically synthesized
ccaaaggagaccuauagu

SEQ ID NO: 3185 - RNA, 18 nt, artificial
  Chemically synthesized
agaguuugaugacuguac

SEQ ID NO: 3186 - RNA, 18 nt, artificial
  Chemically synthesized
gccugugguauaugaaaa

SEQ ID NO: 3187 - RNA, 18 nt, artificial
  Chemically synthesized
cauccaauggaauuaaca

SEQ ID NO: 3188 - RNA, 18 nt, artificial
  Chemically synthesized
guugggaucuuuauguca

SEQ ID NO: 3189 - RNA, 18 nt, artificial
  Chemically synthesized
cugguuccuuguuuacuu

SEQ ID NO: 3190 - RNA, 18 nt, artificial
  Chemically synthesized
gcgauaaaguccuagguu

SEQ ID NO: 3191 - RNA, 18 nt, artificial
  Chemically synthesized
cuggguggagaaccuuau

SEQ ID NO: 3192 - RNA, 18 nt, artificial
  Chemically synthesized
gggaucuuuaugucacua

SEQ ID NO: 3193 - RNA, 18 nt, artificial
  Chemically synthesized
ccuggcaaguggaucauu

SEQ ID NO: 3194 - RNA, 18 nt, artificial
  Chemically synthesized
ggaauuaacacaauagag

SEQ ID NO: 3195 - RNA, 18 nt, artificial
  Chemically synthesized
gucaauucagaauguaag

SEQ ID NO: 3196 - RNA, 18 nt, artificial
  Chemically synthesized
cauugagaaaaaagccau

SEQ ID NO: 3197 - RNA, 18 nt, artificial
  Chemically synthesized
caguguaacaggcugcau

SEQ ID NO: 3198 - RNA, 18 nt, artificial
  Chemically synthesized
ggaacaucugcuaugaug

SEQ ID NO: 3199 - RNA, 18 nt, artificial
  Chemically synthesized
agcaggauccaaaggaga

SEQ ID NO: 3200 - RNA, 18 nt, artificial
  Chemically synthesized
ggagaccuauagugacuc

SEQ ID NO: 3201 - RNA, 18 nt, artificial
  Chemically synthesized
gugugaaccuccaggcuc

SEQ ID NO: 3202 - RNA, 18 nt, artificial
  Chemically synthesized
gcagaacccauggauaua

SEQ ID NO: 3203 - RNA, 18 nt, artificial
  Chemically synthesized
auccaaaggagaccuaua

SEQ ID NO: 3204 - RNA, 18 nt, artificial
  Chemically synthesized
gagcuaugagccaaaaag

SEQ ID NO: 3205 - RNA, 18 nt, artificial
  Chemically synthesized
gcugcauucccaagacac

SEQ ID NO: 3206 - RNA, 18 nt, artificial
  Chemically synthesized
gcacaaaugaacuuaaga

SEQ ID NO: 3207 - RNA, 18 nt, artificial
  Chemically synthesized
cccuuucuucuuuaacau

SEQ ID NO: 3208 - RNA, 18 nt, artificial
  Chemically synthesized
gaauauagucccuuggua

SEQ ID NO: 3209 - RNA, 18 nt, artificial
  Chemically synthesized
agaccagucuuugucuag

SEQ ID NO: 3210 - RNA, 18 nt, artificial
  Chemically synthesized
aguuguggguugaagcac

SEQ ID NO: 3211 - RNA, 18 nt, artificial
  Chemically synthesized
ggcaauaacuucauuugc

SEQ ID NO: 3212 - RNA, 18 nt, artificial
  Chemically synthesized
caaggaagaauccuccaa

SEQ ID NO: 3213 - RNA, 18 nt, artificial
  Chemically synthesized
ccacaaaacugucuuugu

SEQ ID NO: 3214 - RNA, 18 nt, artificial
  Chemically synthesized
gguggcaauaacuucauu

SEQ ID NO: 3215 - RNA, 18 nt, artificial
  Chemically synthesized
guaggaaugcaauaacua

SEQ ID NO: 3216 - RNA, 18 nt, artificial
  Chemically synthesized
ggcuucucugucuuguga

SEQ ID NO: 3217 - RNA, 18 nt, artificial
  Chemically synthesized
cucuuucacugcuuucaa

SEQ ID NO: 3218 - RNA, 18 nt, artificial
  Chemically synthesized
gagcaacuugacucauuu

SEQ ID NO: 3219 - RNA, 18 nt, artificial
  Chemically synthesized
caagcaggauccaaagga

SEQ ID NO: 3220 - RNA, 18 nt, artificial
  Chemically synthesized
ggauuguuagaauuagag

SEQ ID NO: 3221 - RNA, 18 nt, artificial
  Chemically synthesized
aguccuagguucccauau

SEQ ID NO: 3222 - RNA, 18 nt, artificial
  Chemically synthesized
gcaauaacuucauuugcu

SEQ ID NO: 3223 - RNA, 18 nt, artificial
  Chemically synthesized
gguccugugccaccguuu

SEQ ID NO: 3224 - RNA, 18 nt, artificial
  Chemically synthesized
cguggauaucaaaauuca

SEQ ID NO: 3225 - RNA, 18 nt, artificial
  Chemically synthesized
ccggagagacuuugcuca

SEQ ID NO: 3226 - RNA, 18 nt, artificial
  Chemically synthesized
aguguaacaggcugcauu

SEQ ID NO: 3227 - RNA, 18 nt, artificial
  Chemically synthesized
ggaagcugguggcaauaa

SEQ ID NO: 3228 - RNA, 18 nt, artificial
  Chemically synthesized
gagugaguggugcaagua

SEQ ID NO: 3229 - RNA, 18 nt, artificial
  Chemically synthesized
cucauuucacacacugaa

SEQ ID NO: 3230 - RNA, 18 nt, artificial
  Chemically synthesized
cuccaaucaggcuucucu

SEQ ID NO: 3231 - RNA, 18 nt, artificial
  Chemically synthesized
gggaaauauggacaccuu

SEQ ID NO: 3232 - RNA, 18 nt, artificial
  Chemically synthesized
cccaggagcucuuaguga

SEQ ID NO: 3233 - RNA, 18 nt, artificial
  Chemically synthesized
ggagcucuuagugaccaa

SEQ ID NO: 3234 - RNA, 18 nt, artificial
  Chemically synthesized
caggcugcauucccaaga

SEQ ID NO: 3235 - RNA, 18 nt, artificial
  Chemically synthesized
gacaccuucacuaagauu

SEQ ID NO: 3236 - RNA, 18 nt, artificial
  Chemically synthesized
ggaggcugcauauuccaa

SEQ ID NO: 3237 - RNA, 18 nt, artificial
  Chemically synthesized
gacuguacccuuaaugga

SEQ ID NO: 3238 - RNA, 18 nt, artificial
  Chemically synthesized
agauaaugaacaccaaga

SEQ ID NO: 3239 - RNA, 18 nt, artificial
  Chemically synthesized
gacuaacauugauaucag

SEQ ID NO: 3240 - RNA, 18 nt, artificial
  Chemically synthesized
cucacaaaauugcaaauc

SEQ ID NO: 3241 - RNA, 18 nt, artificial
  Chemically synthesized
agauuuugcuggacuuac

SEQ ID NO: 3242 - RNA, 18 nt, artificial
  Chemically synthesized
ggacaccuucacuaagau

SEQ ID NO: 3243 - RNA, 18 nt, artificial
  Chemically synthesized
cugcuaugaugcauuugu

SEQ ID NO: 3244 - RNA, 18 nt, artificial
  Chemically synthesized
gcauauuccaagguuuua

SEQ ID NO: 3245 - RNA, 18 nt, artificial
  Chemically synthesized
ggaaauccuuacaaaacc

SEQ ID NO: 3246 - RNA, 18 nt, artificial
  Chemically synthesized
gcaaguaugaacuggacu

SEQ ID NO: 3247 - RNA, 18 nt, artificial
  Chemically synthesized
gucuugaacauuuagacu

SEQ ID NO: 3248 - RNA, 18 nt, artificial
  Chemically synthesized
gcuuaguucauuaggaaa

SEQ ID NO: 3249 - RNA, 18 nt, artificial
  Chemically synthesized
cuaagagacuccucugug

SEQ ID NO: 3250 - RNA, 18 nt, artificial
  Chemically synthesized
gccacaaaaggcauucuc

SEQ ID NO: 3251 - RNA, 18 nt, artificial
  Chemically synthesized
ggaagauucuuuuucuuc

SEQ ID NO: 3252 - RNA, 18 nt, artificial
  Chemically synthesized
gguccaggagcuggagaa

SEQ ID NO: 3253 - RNA, 18 nt, artificial
  Chemically synthesized
aucugauaaugacagagu

SEQ ID NO: 3254 - RNA, 18 nt, artificial
  Chemically synthesized
gagcuggagaacuucaau

SEQ ID NO: 3255 - RNA, 18 nt, artificial
  Chemically synthesized
gcuccugugaauuccucu

SEQ ID NO: 3256 - RNA, 18 nt, artificial
  Chemically synthesized
gguucaggauguccgccu

SEQ ID NO: 3257 - RNA, 18 nt, artificial
  Chemically synthesized
cggagagacuuugcucac

SEQ ID NO: 3258 - RNA, 18 nt, artificial
  Chemically synthesized
cacagaagcuguaaaaag

SEQ ID NO: 3259 - RNA, 18 nt, artificial
  Chemically synthesized
ccugaaacuugucagugg

SEQ ID NO: 3260 - RNA, 18 nt, artificial
  Chemically synthesized
gcuucucugucuugugac

SEQ ID NO: 3261 - RNA, 18 nt, artificial
  Chemically synthesized
agugcuguguauuuccua

SEQ ID NO: 3262 - RNA, 18 nt, artificial
  Chemically synthesized
ccugugaauuccucuccu

SEQ ID NO: 3263 - RNA, 18 nt, artificial
  Chemically synthesized
caguaggaaugcaauaac

SEQ ID NO: 3264 - RNA, 18 nt, artificial
  Chemically synthesized
gagccacaaaacugucuu

SEQ ID NO: 3265 - RNA, 18 nt, artificial
  Chemically synthesized
ccuacuggguggagaacc

SEQ ID NO: 3266 - RNA, 18 nt, artificial
  Chemically synthesized
ccuugaggaacuugagau

SEQ ID NO: 3267 - RNA, 18 nt, artificial
  Chemically synthesized
gauugauuggccagcaaa

SEQ ID NO: 3268 - RNA, 18 nt, artificial
  Chemically synthesized
cuacauuagcaacaguga

SEQ ID NO: 3269 - RNA, 18 nt, artificial
  Chemically synthesized
guggauguaccgucauuu

SEQ ID NO: 3270 - RNA, 18 nt, artificial
  Chemically synthesized
gcuaugaugcauuuguuu

SEQ ID NO: 3271 - RNA, 18 nt, artificial
  Chemically synthesized
gugcaaguaugaacugga

SEQ ID NO: 3272 - RNA, 18 nt, artificial
  Chemically synthesized
guuugaugacuguacccu

SEQ ID NO: 3273 - RNA, 18 nt, artificial
  Chemically synthesized
gaauacacaguguaacag

SEQ ID NO: 3274 - RNA, 18 nt, artificial
  Chemically synthesized
gaaaaaaccggagagacu

SEQ ID NO: 3275 - RNA, 18 nt, artificial
  Chemically synthesized
aggacuugcuuacuaaaa

SEQ ID NO: 3276 - RNA, 18 nt, artificial
  Chemically synthesized
auauuuuacugcuggaga

SEQ ID NO: 3277 - RNA, 18 nt, artificial
  Chemically synthesized
guggaucauugacaauau

SEQ ID NO: 3278 - RNA, 18 nt, artificial
  Chemically synthesized
ccagaaauaaguugauga

SEQ ID NO: 3279 - RNA, 18 nt, artificial
  Chemically synthesized
gaucuuuaugucacuagu

SEQ ID NO: 3280 - RNA, 18 nt, artificial
  Chemically synthesized
aaggaagaauccuccaau

SEQ ID NO: 3281 - RNA, 18 nt, artificial
  Chemically synthesized
gcaggauccaaaggagac

SEQ ID NO: 3282 - RNA, 18 nt, artificial
  Chemically synthesized
gaagauaaugaacaccaa

SEQ ID NO: 3283 - RNA, 18 nt, artificial
  Chemically synthesized
cugagcacuuuauauuca

SEQ ID NO: 3284 - RNA, 18 nt, artificial
  Chemically synthesized
agcaacaaggcaaaguau

SEQ ID NO: 3285 - RNA, 18 nt, artificial
  Chemically synthesized
acugcgagauacugauuu

SEQ ID NO: 3286 - RNA, 18 nt, artificial
  Chemically synthesized
agcuggagaacuucaauc

SEQ ID NO: 3287 - RNA, 18 nt, artificial
  Chemically synthesized
ccauauuuaagaccaguc

SEQ ID NO: 3288 - RNA, 18 nt, artificial
  Chemically synthesized
caaguugugucuucauaa

SEQ ID NO: 3289 - RNA, 18 nt, artificial
  Chemically synthesized
cugugaauuccucuccuu

SEQ ID NO: 3290 - RNA, 18 nt, artificial
  Chemically synthesized
aguguuugguguugcaag

SEQ ID NO: 3291 - RNA, 18 nt, artificial
  Chemically synthesized
gaucugagcacuuuauau

SEQ ID NO: 3292 - RNA, 18 nt, artificial
  Chemically synthesized
gugaccaagugaagguac

SEQ ID NO: 3293 - RNA, 18 nt, artificial
  Chemically synthesized
cccucagggcucacagaa

SEQ ID NO: 3294 - RNA, 18 nt, artificial
  Chemically synthesized
gaguucucccaguguuug

SEQ ID NO: 3295 - RNA, 18 nt, artificial
  Chemically synthesized
cuggagaacuucaauccc

SEQ ID NO: 3296 - RNA, 18 nt, artificial
  Chemically synthesized
cuaugagauaaccaugau

SEQ ID NO: 3297 - RNA, 18 nt, artificial
  Chemically synthesized
gcuuucaacugguaguug

SEQ ID NO: 3298 - RNA, 18 nt, artificial
  Chemically synthesized
guuugguguugcaagcag

SEQ ID NO: 3299 - RNA, 18 nt, artificial
  Chemically synthesized
gccacauacuuuguggau

SEQ ID NO: 3300 - RNA, 18 nt, artificial
  Chemically synthesized
gagccaaaaaguuugaag

SEQ ID NO: 3301 - RNA, 18 nt, artificial
  Chemically synthesized
ccacauacuuuguggaug

SEQ ID NO: 3302 - RNA, 18 nt, artificial
  Chemically synthesized
cagugaaaauuugauggu

SEQ ID NO: 3303 - RNA, 18 nt, artificial
  Chemically synthesized
ccagcaaauuaccugugu

SEQ ID NO: 3304 - RNA, 18 nt, artificial
  Chemically synthesized
cuugaaaaauucagccug

SEQ ID NO: 3305 - RNA, 18 nt, artificial
  Chemically synthesized
cacaaaauugcaaauccu

SEQ ID NO: 3306 - RNA, 18 nt, artificial
  Chemically synthesized
cugucuugugaccgcaau

SEQ ID NO: 3307 - RNA, 18 nt, artificial
  Chemically synthesized
ugaugacucuaccagaug

SEQ ID NO: 3308 - RNA, 18 nt, artificial
  Chemically synthesized
gcaacuggcuuaguucau

SEQ ID NO: 3309 - RNA, 18 nt, artificial
  Chemically synthesized
ggccacaaaaggcauucu

SEQ ID NO: 3310 - RNA, 18 nt, artificial
  Chemically synthesized
gcaggauccucguggaua

SEQ ID NO: 3311 - RNA, 18 nt, artificial
  Chemically synthesized
gauguaccgucauuugag

SEQ ID NO: 3312 - RNA, 18 nt, artificial
  Chemically synthesized
ucggaguucucccagugu

SEQ ID NO: 3313 - RNA, 18 nt, artificial
  Chemically synthesized
ugggaaauccuuacaaaa

SEQ ID NO: 3314 - RNA, 18 nt, artificial
  Chemically synthesized
cauggaugcagaacccau

SEQ ID NO: 3315 - RNA, 18 nt, artificial
  Chemically synthesized
ugaagacuuuggaagcug

SEQ ID NO: 3316 - RNA, 18 nt, artificial
  Chemically synthesized
ggaugcagaacccaugga

SEQ ID NO: 3317 - RNA, 18 nt, artificial
  Chemically synthesized
gauucucaaugacugugu

SEQ ID NO: 3318 - RNA, 18 nt, artificial
  Chemically synthesized
agccaaaaaguuugaagu

SEQ ID NO: 3319 - RNA, 18 nt, artificial
  Chemically synthesized
gagauugaugcuucagau

SEQ ID NO: 3320 - RNA, 18 nt, artificial
  Chemically synthesized
gguaauuuuagagcaucu

SEQ ID NO: 3321 - RNA, 18 nt, artificial
  Chemically synthesized
ggaaggauuuuggguaaa

SEQ ID NO: 3322 - RNA, 18 nt, artificial
  Chemically synthesized
gcaucugauaaugacaga

SEQ ID NO: 3323 - RNA, 18 nt, artificial
  Chemically synthesized
gauguuagcaacaacaau

SEQ ID NO: 3324 - RNA, 18 nt, artificial
  Chemically synthesized
gaacuggacuucucccau

SEQ ID NO: 3325 - RNA, 18 nt, artificial
  Chemically synthesized
gcgagaaagcgcagccag

SEQ ID NO: 3326 - RNA, 18 nt, artificial
  Chemically synthesized
cauuucacacacugaaga

SEQ ID NO: 3327 - RNA, 18 nt, artificial
  Chemically synthesized
ccugggcagucuugaaca

SEQ ID NO: 3328 - RNA, 18 nt, artificial
  Chemically synthesized
gcugcggaagauaaugaa

SEQ ID NO: 3329 - RNA, 18 nt, artificial
  Chemically synthesized
agcuaugagccaaaaagu

SEQ ID NO: 3330 - RNA, 18 nt, artificial
  Chemically synthesized
caaucaggcuucucuguc

SEQ ID NO: 3331 - RNA, 18 nt, artificial
  Chemically synthesized
acuggguggagaaccuua

SEQ ID NO: 3332 - RNA, 18 nt, artificial
  Chemically synthesized
ugaaaaucaccgaugaaa

SEQ ID NO: 3333 - RNA, 18 nt, artificial
  Chemically synthesized
cugauaaugacagaguua

SEQ ID NO: 3334 - RNA, 18 nt, artificial
  Chemically synthesized
gagauacugauuuggaca

SEQ ID NO: 3335 - RNA, 18 nt, artificial
  Chemically synthesized
cuucauuccuggcaagug

SEQ ID NO: 3336 - RNA, 18 nt, artificial
  Chemically synthesized
cccaagacacuggaaauu

SEQ ID NO: 3337 - RNA, 18 nt, artificial
  Chemically synthesized
gguguugcaagcaggauc

SEQ ID NO: 3338 - RNA, 18 nt, artificial
  Chemically synthesized
gcccauugagaaaaaagc

SEQ ID NO: 3339 - RNA, 18 nt, artificial
  Chemically synthesized
gcugacauccaauggaau

SEQ ID NO: 3340 - RNA, 18 nt, artificial
  Chemically synthesized
cacacacugaagacuuug

SEQ ID NO: 3341 - RNA, 18 nt, artificial
  Chemically synthesized
agaccuaccuggaguggc

SEQ ID NO: 3342 - RNA, 18 nt, artificial
  Chemically synthesized
gccacaaaacugucuuug

SEQ ID NO: 3343 - RNA, 18 nt, artificial
  Chemically synthesized
ggcugcucggcguucucu

SEQ ID NO: 3344 - RNA, 18 nt, artificial
  Chemically synthesized
ccaagugaagguaccugu

SEQ ID NO: 3345 - RNA, 18 nt, artificial
  Chemically synthesized
caucugcuaugaugcauu

SEQ ID NO: 3346 - RNA, 18 nt, artificial
  Chemically synthesized
aacuugagauugaugcuu

SEQ ID NO: 3347 - RNA, 18 nt, artificial
  Chemically synthesized
ggaaacagcacaaaugaa

SEQ ID NO: 3348 - RNA, 18 nt, artificial
  Chemically synthesized
caaaauugcaaauccuga

SEQ ID NO: 3349 - RNA, 18 nt, artificial
  Chemically synthesized
gugucauucuuucuuccu

SEQ ID NO: 3350 - RNA, 18 nt, artificial
  Chemically synthesized
gggaaacaucucuuuuuu

SEQ ID NO: 3351 - RNA, 18 nt, artificial
  Chemically synthesized
gucaucugauccuucaua

SEQ ID NO: 3352 - RNA, 18 nt, artificial
  Chemically synthesized
gacauccaauggaauuaa

SEQ ID NO: 3353 - RNA, 18 nt, artificial
  Chemically synthesized
cagguaaaguggaaacgu

SEQ ID NO: 3354 - RNA, 18 nt, artificial
  Chemically synthesized
cugugcagcugaucucaa

SEQ ID NO: 3355 - RNA, 18 nt, artificial
  Chemically synthesized
ggugcuguuuuauaaaca

SEQ ID NO: 3356 - RNA, 18 nt, artificial
  Chemically synthesized
ugaucugagcacuuuaua

SEQ ID NO: 3357 - RNA, 18 nt, artificial
  Chemically synthesized
gcuccaggccaaaaggaa

SEQ ID NO: 3358 - RNA, 18 nt, artificial
  Chemically synthesized
cauaugaagcagcauauu

SEQ ID NO: 3359 - RNA, 18 nt, artificial
  Chemically synthesized
gucaguggccagaaaaga

SEQ ID NO: 3360 - RNA, 18 nt, artificial
  Chemically synthesized
gagagugggaaauaugga

SEQ ID NO: 3361 - RNA, 18 nt, artificial
  Chemically synthesized
cauucucauucuucugga

SEQ ID NO: 3362 - RNA, 18 nt, artificial
  Chemically synthesized
gacugugucauucuuucu

SEQ ID NO: 3363 - RNA, 18 nt, artificial
  Chemically synthesized
ggacagcacuggugucug

SEQ ID NO: 3364 - RNA, 18 nt, artificial
  Chemically synthesized
ggaaugcaauaacuacgu

SEQ ID NO: 3365 - RNA, 18 nt, artificial
  Chemically synthesized
gaggaacuugagauugau

SEQ ID NO: 3366 - RNA, 18 nt, artificial
  Chemically synthesized
guggguugaagcacugga

SEQ ID NO: 3367 - RNA, 18 nt, artificial
  Chemically synthesized
ccagaugccucccucuua

SEQ ID NO: 3368 - RNA, 18 nt, artificial
  Chemically synthesized
cuuucaacugguaguugu

SEQ ID NO: 3369 - RNA, 18 nt, artificial
  Chemically synthesized
gagcaucugauaaugaca

SEQ ID NO: 3370 - RNA, 18 nt, artificial
  Chemically synthesized
gaggcugcauauuccaag

SEQ ID NO: 3371 - RNA, 18 nt, artificial
  Chemically synthesized
cauugacuccauugaaaa

SEQ ID NO: 3372 - RNA, 18 nt, artificial
  Chemically synthesized
uugucuaguugggaucuu

SEQ ID NO: 3373 - RNA, 18 nt, artificial
  Chemically synthesized
caaguuccguggaauguu

SEQ ID NO: 3374 - RNA, 18 nt, artificial
  Chemically synthesized
uggaaaaaaccggagaga

SEQ ID NO: 3375 - RNA, 18 nt, artificial
  Chemically synthesized
uccugagagugggaaaua

SEQ ID NO: 3376 - RNA, 18 nt, artificial
  Chemically synthesized
guggagaaccuuaugguc

SEQ ID NO: 3377 - RNA, 18 nt, artificial
  Chemically synthesized
ggcauucucuguccuacc

SEQ ID NO: 3378 - RNA, 18 nt, artificial
  Chemically synthesized
cacaaaaggcauucucug

SEQ ID NO: 3379 - RNA, 18 nt, artificial
  Chemically synthesized
uggacaccuucacuaaga

SEQ ID NO: 3380 - RNA, 18 nt, artificial
  Chemically synthesized
cuagguucccauauuuaa

SEQ ID NO: 3381 - RNA, 18 nt, artificial
  Chemically synthesized
cgaugaaaguuuguuuca

SEQ ID NO: 3382 - RNA, 18 nt, artificial
  Chemically synthesized
gauccuucauaugaagca

SEQ ID NO: 3383 - RNA, 18 nt, artificial
  Chemically synthesized
agugaccaagugaaggua

SEQ ID NO: 3384 - RNA, 18 nt, artificial
  Chemically synthesized
ugaggaacuugagauuga

SEQ ID NO: 3385 - RNA, 18 nt, artificial
  Chemically synthesized
caagcugcggaagauaau

SEQ ID NO: 3386 - RNA, 18 nt, artificial
  Chemically synthesized
cauuugaggacuugcuua

SEQ ID NO: 3387 - RNA, 18 nt, artificial
  Chemically synthesized
aacuguaaucuguagcaa

SEQ ID NO: 3388 - RNA, 18 nt, artificial
  Chemically synthesized
cagauuucuggauuguua

SEQ ID NO: 3389 - RNA, 18 nt, artificial
  Chemically synthesized
cucaaugacugugucauu

SEQ ID NO: 3390 - RNA, 18 nt, artificial
  Chemically synthesized
aaaggagaccuauaguga

SEQ ID NO: 3391 - RNA, 18 nt, artificial
  Chemically synthesized
ggcaucauuggaaaaaac

SEQ ID NO: 3392 - RNA, 18 nt, artificial
  Chemically synthesized
cauacuuuguggauggug

SEQ ID NO: 3393 - RNA, 18 nt, artificial
  Chemically synthesized
cuguacccuuaauggagu

SEQ ID NO: 3394 - RNA, 18 nt, artificial
  Chemically synthesized
cagugagcgggaugccua

SEQ ID NO: 3395 - RNA, 18 nt, artificial
  Chemically synthesized
ccuugguauccaagggaa

SEQ ID NO: 3396 - RNA, 18 nt, artificial
  Chemically synthesized
aagaccagucuuugucua

SEQ ID NO: 3397 - RNA, 18 nt, artificial
  Chemically synthesized
cuaugaugcauuuguuuc

SEQ ID NO: 3398 - RNA, 18 nt, artificial
  Chemically synthesized
caggcuucucugucuugu

SEQ ID NO: 3399 - RNA, 18 nt, artificial
  Chemically synthesized
agcugguggcaauaacuu

SEQ ID NO: 3400 - RNA, 18 nt, artificial
  Chemically synthesized
ccuggcccucucuacaaa

SEQ ID NO: 3401 - RNA, 18 nt, artificial
  Chemically synthesized
uggagauuuuuguagaug

SEQ ID NO: 3402 - RNA, 18 nt, artificial
  Chemically synthesized
acacaauagaggaagauu

SEQ ID NO: 3403 - RNA, 18 nt, artificial
  Chemically synthesized
uagaauacuuggaucuca

SEQ ID NO: 3404 - RNA, 18 nt, artificial
  Chemically synthesized
gcuaagagacuccucugu

SEQ ID NO: 3405 - RNA, 18 nt, artificial
  Chemically synthesized
gaauguuuggaacugcga

SEQ ID NO: 3406 - RNA, 18 nt, artificial
  Chemically synthesized
agguucccauauuuaaga

SEQ ID NO: 3407 - RNA, 18 nt, artificial
  Chemically synthesized
ccuagaaaaaagugcugu

SEQ ID NO: 3408 - RNA, 18 nt, artificial
  Chemically synthesized
gaacauuuagacuuaucc

SEQ ID NO: 3409 - RNA, 18 nt, artificial
  Chemically synthesized
ccauuuccgucuuuuuga

SEQ ID NO: 3410 - RNA, 18 nt, artificial
  Chemically synthesized
gagaaaaaagccauuccc

SEQ ID NO: 3411 - RNA, 18 nt, artificial
  Chemically synthesized
auuuaagaccagucuuug

SEQ ID NO: 3412 - RNA, 18 nt, artificial
  Chemically synthesized
gguucccauauuuaagac

SEQ ID NO: 3413 - RNA, 18 nt, artificial
  Chemically synthesized
ggauauagagggccaacu

SEQ ID NO: 3414 - RNA, 18 nt, artificial
  Chemically synthesized
cugugucauucuuucuuc

SEQ ID NO: 3415 - RNA, 18 nt, artificial
  Chemically synthesized
gguaaaucugagagcugc

SEQ ID NO: 3416 - RNA, 18 nt, artificial
  Chemically synthesized
accaugaucauaagucua

SEQ ID NO: 3417 - RNA, 18 nt, artificial
  Chemically synthesized
ggugucggaaugucacag

SEQ ID NO: 3418 - RNA, 18 nt, artificial
  Chemically synthesized
gccuacuggguggagaac

SEQ ID NO: 3419 - RNA, 18 nt, artificial
  Chemically synthesized
gcuggacuuaccuuccuu

SEQ ID NO: 3420 - RNA, 18 nt, artificial
  Chemically synthesized
gcuaugagccaaaaaguu

SEQ ID NO: 3421 - RNA, 18 nt, artificial
  Chemically synthesized
agaucuacagagcuauga

SEQ ID NO: 3422 - RNA, 18 nt, artificial
  Chemically synthesized
agagacuuugcucacucu

SEQ ID NO: 3423 - RNA, 18 nt, artificial
  Chemically synthesized
uacccauguuacuaguau

SEQ ID NO: 3424 - RNA, 18 nt, artificial
  Chemically synthesized
agauguuagcaacaacaa

SEQ ID NO: 3425 - RNA, 18 nt, artificial
  Chemically synthesized
gaaauaaguugaugacuc

SEQ ID NO: 3426 - RNA, 18 nt, artificial
  Chemically synthesized
gaucuacagagcuaugag

SEQ ID NO: 3427 - RNA, 18 nt, artificial
  Chemically synthesized
augacugugucauucuuu

SEQ ID NO: 3428 - RNA, 18 nt, artificial
  Chemically synthesized
guugguaauuuuagagca

SEQ ID NO: 3429 - RNA, 18 nt, artificial
  Chemically synthesized
cauuagaauacuuggauc

SEQ ID NO: 3430 - RNA, 18 nt, artificial
  Chemically synthesized
aaaaggaagcccaggaaa

SEQ ID NO: 3431 - RNA, 18 nt, artificial
  Chemically synthesized
gugucuucauaagcggga

SEQ ID NO: 3432 - RNA, 18 nt, artificial
  Chemically synthesized
aggcucuggugcugacau

SEQ ID NO: 3433 - RNA, 18 nt, artificial
  Chemically synthesized
cugagagugggaaauaug

SEQ ID NO: 3434 - RNA, 18 nt, artificial
  Chemically synthesized
ccauuuuucagaacuauc

SEQ ID NO: 3435 - RNA, 18 nt, artificial
  Chemically synthesized
gacaaugccacauacuuu

SEQ ID NO: 3436 - RNA, 18 nt, artificial
  Chemically synthesized
gaaaaauucagccuguga

SEQ ID NO: 3437 - RNA, 18 nt, artificial
  Chemically synthesized
gcagcauauuuuacugcu

SEQ ID NO: 3438 - RNA, 18 nt, artificial
  Chemically synthesized
ggccaaagucuugauuga

SEQ ID NO: 3439 - RNA, 18 nt, artificial
  Chemically synthesized
caauccggaggcugcaua

SEQ ID NO: 3440 - RNA, 18 nt, artificial
  Chemically synthesized
gaguuugaugacuguacc

SEQ ID NO: 3441 - RNA, 18 nt, artificial
  Chemically synthesized
caaaaggcauucucuguc

SEQ ID NO: 3442 - RNA, 18 nt, artificial
  Chemically synthesized
cggcguucucucagguga

SEQ ID NO: 3443 - RNA, 18 nt, artificial
  Chemically synthesized
gaaaagagccacaaaacu

SEQ ID NO: 3444 - RNA, 18 nt, artificial
  Chemically synthesized
aggcauucucuguccuac

SEQ ID NO: 3445 - RNA, 18 nt, artificial
  Chemically synthesized
gcaaauuaccugugugac

SEQ ID NO: 3446 - RNA, 18 nt, artificial
  Chemically synthesized
ccgcaacucaaagaacuu

SEQ ID NO: 3447 - RNA, 18 nt, artificial
  Chemically synthesized
gaagcugguggcaauaac

SEQ ID NO: 3448 - RNA, 18 nt, artificial
  Chemically synthesized
cguggaauguuuggaacu

SEQ ID NO: 3449 - RNA, 18 nt, artificial
  Chemically synthesized
ggucaucaucagccucuc

SEQ ID NO: 3450 - RNA, 18 nt, artificial
  Chemically synthesized
agcgagaaagcgcagcca

SEQ ID NO: 3451 - RNA, 18 nt, artificial
  Chemically synthesized
aucugaauauagucccuu

SEQ ID NO: 3452 - RNA, 18 nt, artificial
  Chemically synthesized
ugaugguugaagaauacu

SEQ ID NO: 3453 - RNA, 18 nt, artificial
  Chemically synthesized
acuguaaucuguagcaac

SEQ ID NO: 3454 - RNA, 18 nt, artificial
  Chemically synthesized
ccucguggauaucaaaau

SEQ ID NO: 3455 - RNA, 18 nt, artificial
  Chemically synthesized
cuaccuagcugucacuuc

SEQ ID NO: 3456 - RNA, 18 nt, artificial
  Chemically synthesized
ucugguuccuuguuuacu

SEQ ID NO: 3457 - RNA, 18 nt, artificial
  Chemically synthesized
ccaggagcuggagaacuu

SEQ ID NO: 3458 - RNA, 18 nt, artificial
  Chemically synthesized
cguggauguaccgucauu

SEQ ID NO: 3459 - RNA, 18 nt, artificial
  Chemically synthesized
aguggaaacguuaacaau

SEQ ID NO: 3460 - RNA, 18 nt, artificial
  Chemically synthesized
aaaaaaccggagagacuu

SEQ ID NO: 3461 - RNA, 18 nt, artificial
  Chemically synthesized
guuguggguugaagcacu

SEQ ID NO: 3462 - RNA, 18 nt, artificial
  Chemically synthesized
ggauggugugggucuugg

SEQ ID NO: 3463 - RNA, 18 nt, artificial
  Chemically synthesized
caauaucauugacuccau

SEQ ID NO: 3464 - RNA, 18 nt, artificial
  Chemically synthesized
cgauaaaguccuagguuc

SEQ ID NO: 3465 - RNA, 18 nt, artificial
  Chemically synthesized
gaccuauagugacuccca

SEQ ID NO: 3466 - RNA, 18 nt, artificial
  Chemically synthesized
gcuggagaacuucaaucc

SEQ ID NO: 3467 - RNA, 18 nt, artificial
  Chemically synthesized
caacaaggcaaaguauuu

SEQ ID NO: 3468 - RNA, 18 nt, artificial
  Chemically synthesized
agcacuggugucuggcau

SEQ ID NO: 3469 - RNA, 18 nt, artificial
  Chemically synthesized
gaagcagcauauuuuacu

SEQ ID NO: 3470 - RNA, 18 nt, artificial
  Chemically synthesized
cuuugaauuugccgcaac

SEQ ID NO: 3471 - RNA, 18 nt, artificial
  Chemically synthesized
gaauuccucuccuucacu

SEQ ID NO: 3472 - RNA, 18 nt, artificial
  Chemically synthesized
ccucucuacaaacuuuaa

SEQ ID NO: 3473 - RNA, 18 nt, artificial
  Chemically synthesized
guagcaacuggcuuaguu

SEQ ID NO: 3474 - RNA, 18 nt, artificial
  Chemically synthesized
cucccauuuccgucuuuu

SEQ ID NO: 3475 - RNA, 18 nt, artificial
  Chemically synthesized
gaugagaacaaugaugcu

SEQ ID NO: 3476 - RNA, 18 nt, artificial
  Chemically synthesized
ugcucggaguucucccag

SEQ ID NO: 3477 - RNA, 18 nt, artificial
  Chemically synthesized
ucuuugucuaguugggau

SEQ ID NO: 3478 - RNA, 18 nt, artificial
  Chemically synthesized
gauaaugaacaccaagac

SEQ ID NO: 3479 - RNA, 18 nt, artificial
  Chemically synthesized
aggaacaucugcuaugau

SEQ ID NO: 3480 - RNA, 18 nt, artificial
  Chemically synthesized
ugcucacucugaaaaacu

SEQ ID NO: 3481 - RNA, 18 nt, artificial
  Chemically synthesized
ccuugaccuguccaacaa

SEQ ID NO: 3482 - RNA, 18 nt, artificial
  Chemically synthesized
auucuaugccugaaacuu

SEQ ID NO: 3483 - RNA, 18 nt, artificial
  Chemically synthesized
aaggcauucucuguccua

SEQ ID NO: 3484 - RNA, 18 nt, artificial
  Chemically synthesized
uucccaagacacuggaaa

SEQ ID NO: 3485 - RNA, 18 nt, artificial
  Chemically synthesized
caaguaugaacuggacuu

SEQ ID NO: 3486 - RNA, 18 nt, artificial
  Chemically synthesized
uggaucucagugaaaauu

SEQ ID NO: 3487 - RNA, 18 nt, artificial
  Chemically synthesized
cuuacugggaaauccuua

SEQ ID NO: 3488 - RNA, 18 nt, artificial
  Chemically synthesized
acguuuucuaaggagcaa

SEQ ID NO: 3489 - RNA, 18 nt, artificial
  Chemically synthesized
acugugucauucuuucuu

SEQ ID NO: 3490 - RNA, 18 nt, artificial
  Chemically synthesized
cauucuucuggagcccau

SEQ ID NO: 3491 - RNA, 18 nt, artificial
  Chemically synthesized
ugagaacaaugaugcugc

SEQ ID NO: 3492 - RNA, 18 nt, artificial
  Chemically synthesized
acuacguuuucuaaggag

SEQ ID NO: 3493 - RNA, 18 nt, artificial
  Chemically synthesized
ccuucauaugaagcagca

SEQ ID NO: 3494 - RNA, 18 nt, artificial
  Chemically synthesized
gaaacuugucaguggcca

SEQ ID NO: 3495 - RNA, 18 nt, artificial
  Chemically synthesized
uguagauguuacaaguuc

SEQ ID NO: 3496 - RNA, 18 nt, artificial
  Chemically synthesized
cuucauggaugcagaacc

SEQ ID NO: 3497 - RNA, 18 nt, artificial
  Chemically synthesized
ccuacagaggugugugaa

SEQ ID NO: 3498 - RNA, 18 nt, artificial
  Chemically synthesized
cugaagacuuuggaagcu

SEQ ID NO: 3499 - RNA, 18 nt, artificial
  Chemically synthesized
augagauaaccaugauca

SEQ ID NO: 3500 - RNA, 18 nt, artificial
  Chemically synthesized
gauuuuggguaaaucuga

SEQ ID NO: 3501 - RNA, 18 nt, artificial
  Chemically synthesized
cuugugaccgcaauggua

SEQ ID NO: 3502 - RNA, 18 nt, artificial
  Chemically synthesized
acuucauggaugcagaac

SEQ ID NO: 3503 - RNA, 18 nt, artificial
  Chemically synthesized
gaacugcgagauacugau

SEQ ID NO: 3504 - RNA, 18 nt, artificial
  Chemically synthesized
aguggugcaaguaugaac

SEQ ID NO: 3505 - RNA, 18 nt, artificial
  Chemically synthesized
ugcauuuguuucuuacag

SEQ ID NO: 3506 - RNA, 18 nt, artificial
  Chemically synthesized
acaauaucauugacucca

SEQ ID NO: 3507 - RNA, 18 nt, artificial
  Chemically synthesized
ugcuucagaucuacagag

SEQ ID NO: 3508 - RNA, 18 nt, artificial
  Chemically synthesized
cacgaauacacaguguaa

SEQ ID NO: 3509 - RNA, 18 nt, artificial
  Chemically synthesized
aggcaaaaucauuuggca

SEQ ID NO: 3510 - RNA, 18 nt, artificial
  Chemically synthesized
cgaauacacaguguaaca

SEQ ID NO: 3511 - RNA, 18 nt, artificial
  Chemically synthesized
gcuauuccuagaaaaaag

SEQ ID NO: 3512 - RNA, 18 nt, artificial
  Chemically synthesized
gugugacucuccauccca

SEQ ID NO: 3513 - RNA, 18 nt, artificial
  Chemically synthesized
cucccaguguuugguguu

SEQ ID NO: 3514 - RNA, 18 nt, artificial
  Chemically synthesized
ggcucuggugcugacauc

SEQ ID NO: 3515 - RNA, 18 nt, artificial
  Chemically synthesized
guaagucaucugauccuu

SEQ ID NO: 3516 - RNA, 18 nt, artificial
  Chemically synthesized
gcaagcugcggaagauaa

SEQ ID NO: 3517 - RNA, 18 nt, artificial
  Chemically synthesized
gugcuguguauuuccuau

SEQ ID NO: 3518 - RNA, 18 nt, artificial
  Chemically synthesized
gaugaaaguuuguuucag

SEQ ID NO: 3519 - RNA, 18 nt, artificial
  Chemically synthesized
cauucuaugccugaaacu

SEQ ID NO: 3520 - RNA, 18 nt, artificial
  Chemically synthesized
uucacacacugaagacuu

SEQ ID NO: 3521 - RNA, 18 nt, artificial
  Chemically synthesized
ggguccugugccaccguu

SEQ ID NO: 3522 - RNA, 18 nt, artificial
  Chemically synthesized
caacagugaccuacagag

SEQ ID NO: 3523 - RNA, 18 nt, artificial
  Chemically synthesized
auucuuucuuccugcuaa

SEQ ID NO: 3524 - RNA, 18 nt, artificial
  Chemically synthesized
cauuugcuccugugaauu

SEQ ID NO: 3525 - RNA, 18 nt, artificial
  Chemically synthesized
uagaguuugaugacugua

SEQ ID NO: 3526 - RNA, 18 nt, artificial
  Chemically synthesized
ugguaguuguggguugaa

SEQ ID NO: 3527 - RNA, 18 nt, artificial
  Chemically synthesized
accagucuuugucuaguu

SEQ ID NO: 3528 - RNA, 18 nt, artificial
  Chemically synthesized
aggagcaacuugacucau

SEQ ID NO: 3529 - RNA, 18 nt, artificial
  Chemically synthesized
gcucacucugaaaaacuu

SEQ ID NO: 3530 - RNA, 18 nt, artificial
  Chemically synthesized
gcacacgaauacacagug

SEQ ID NO: 3531 - RNA, 18 nt, artificial
  Chemically synthesized
auuggaaaaaaccggaga

SEQ ID NO: 3532 - RNA, 18 nt, artificial
  Chemically synthesized
cuuaauggaguugguaau

SEQ ID NO: 3533 - RNA, 18 nt, artificial
  Chemically synthesized
cuuccuugaggaacuuga

SEQ ID NO: 3534 - RNA, 18 nt, artificial
  Chemically synthesized
ucuaguugggaucuuuau

SEQ ID NO: 3535 - RNA, 18 nt, artificial
  Chemically synthesized
gaaggauuuuggguaaau

SEQ ID NO: 3536 - RNA, 18 nt, artificial
  Chemically synthesized
agcgggacuucauuccug

SEQ ID NO: 3537 - RNA, 18 nt, artificial
  Chemically synthesized
cucggugucggaauguca

SEQ ID NO: 3538 - RNA, 18 nt, artificial
  Chemically synthesized
caauagaggaagauucuu

SEQ ID NO: 3539 - RNA, 18 nt, artificial
  Chemically synthesized
caagggaauugguugcag

SEQ ID NO: 3540 - RNA, 18 nt, artificial
  Chemically synthesized
ggcaugugcugugcucug

SEQ ID NO: 3541 - RNA, 18 nt, artificial
  Chemically synthesized
uguggauggugugggucu

SEQ ID NO: 3542 - RNA, 18 nt, artificial
  Chemically synthesized
ccucagggcucacagaag

SEQ ID NO: 3543 - RNA, 18 nt, artificial
  Chemically synthesized
gacucuaccagaugccuc

SEQ ID NO: 3544 - RNA, 18 nt, artificial
  Chemically synthesized
cucggaguucucccagug

SEQ ID NO: 3545 - RNA, 18 nt, artificial
  Chemically synthesized
ucagaauguaagucaucu

SEQ ID NO: 3546 - RNA, 18 nt, artificial
  Chemically synthesized
ugaugagaacaaugaugc

SEQ ID NO: 3547 - RNA, 18 nt, artificial
  Chemically synthesized
ugcaaauccugagagugg

SEQ ID NO: 3548 - RNA, 18 nt, artificial
  Chemically synthesized
aguugugucuucauaagc

SEQ ID NO: 3549 - RNA, 18 nt, artificial
  Chemically synthesized
cguuuucuaaggagcaac

SEQ ID NO: 3550 - RNA, 18 nt, artificial
  Chemically synthesized
gcaucauuggaaaaaacc

SEQ ID NO: 3551 - RNA, 18 nt, artificial
  Chemically synthesized
ccagcacacgaauacaca

SEQ ID NO: 3552 - RNA, 18 nt, artificial
  Chemically synthesized
ucuaugagauaaccauga

SEQ ID NO: 3553 - RNA, 18 nt, artificial
  Chemically synthesized
ugaagucaauucagaaug

SEQ ID NO: 3554 - RNA, 18 nt, artificial
  Chemically synthesized
gaggaagauucuuuuucu

SEQ ID NO: 3555 - RNA, 18 nt, artificial
  Chemically synthesized
agaauguaagucaucuga

SEQ ID NO: 3556 - RNA, 18 nt, artificial
  Chemically synthesized
cauugugcccauugcucu

SEQ ID NO: 3557 - RNA, 18 nt, artificial
  Chemically synthesized
aguuuucauucuaugccu

SEQ ID NO: 3558 - RNA, 18 nt, artificial
  Chemically synthesized
gauacugauuuggacacu

SEQ ID NO: 3559 - RNA, 18 nt, artificial
  Chemically synthesized
ccugugguauaugaaaau

SEQ ID NO: 3560 - RNA, 18 nt, artificial
  Chemically synthesized
cucuguuccugcugaucc

SEQ ID NO: 3561 - RNA, 18 nt, artificial
  Chemically synthesized
agaacaaugaugcugcca

SEQ ID NO: 3562 - RNA, 18 nt, artificial
  Chemically synthesized
cuccauucccucagggcu

SEQ ID NO: 3563 - RNA, 18 nt, artificial
  Chemically synthesized
caaauuaccugugugacu

SEQ ID NO: 3564 - RNA, 18 nt, artificial
  Chemically synthesized
ugaugacuguacccuuaa

SEQ ID NO: 3565 - RNA, 18 nt, artificial
  Chemically synthesized
gaaaacuuugugaagagu

SEQ ID NO: 3566 - RNA, 18 nt, artificial
  Chemically synthesized
cuugguauccaagggaau

SEQ ID NO: 3567 - RNA, 18 nt, artificial
  Chemically synthesized
ugccauucucauucuucu

SEQ ID NO: 3568 - RNA, 18 nt, artificial
  Chemically synthesized
cuucaaguugugucuuca

SEQ ID NO: 3569 - RNA, 18 nt, artificial
  Chemically synthesized
ugguguugcaagcaggau

SEQ ID NO: 3570 - RNA, 18 nt, artificial
  Chemically synthesized
aggccaaaaggaagccca

SEQ ID NO: 3571 - RNA, 18 nt, artificial
  Chemically synthesized
ccguggaauguuuggaac

SEQ ID NO: 3572 - RNA, 18 nt, artificial
  Chemically synthesized
augcagaacccauggaua

SEQ ID NO: 3573 - RNA, 18 nt, artificial
  Chemically synthesized
cuuugucuaguugggauc

SEQ ID NO: 3574 - RNA, 18 nt, artificial
  Chemically synthesized
gaaaaaagugcuguguau

SEQ ID NO: 3575 - RNA, 18 nt, artificial
  Chemically synthesized
gagugggaaauauggaca

SEQ ID NO: 3576 - RNA, 18 nt, artificial
  Chemically synthesized
ugguugacuucauggaug

SEQ ID NO: 3577 - RNA, 18 nt, artificial
  Chemically synthesized
cauugcucuuucacugcu

SEQ ID NO: 3578 - RNA, 18 nt, artificial
  Chemically synthesized
ggcguucucucaggugac

SEQ ID NO: 3579 - RNA, 18 nt, artificial
  Chemically synthesized
guggaaacguuaacaauc

SEQ ID NO: 3580 - RNA, 18 nt, artificial
  Chemically synthesized
cauaagcgggacuucauu

SEQ ID NO: 3581 - RNA, 18 nt, artificial
  Chemically synthesized
aggcucagcgggaaggau

SEQ ID NO: 3582 - RNA, 18 nt, artificial
  Chemically synthesized
auugcaaauccugagagu

SEQ ID NO: 3583 - RNA, 18 nt, artificial
  Chemically synthesized
aggauuuuggguaaaucu

SEQ ID NO: 3584 - RNA, 18 nt, artificial
  Chemically synthesized
acacugaagacuuuggaa

SEQ ID NO: 3585 - RNA, 18 nt, artificial
  Chemically synthesized
agccucuccaaggaagaa

SEQ ID NO: 3586 - RNA, 18 nt, artificial
  Chemically synthesized
agcugaucucaagagcaa

SEQ ID NO: 3587 - RNA, 18 nt, artificial
  Chemically synthesized
cuaaggagcaacuugacu

SEQ ID NO: 3588 - RNA, 18 nt, artificial
  Chemically synthesized
gaguuaaaagaaucacag

SEQ ID NO: 3589 - RNA, 18 nt, artificial
  Chemically synthesized
cuggugcugacauccaau

SEQ ID NO: 3590 - RNA, 18 nt, artificial
  Chemically synthesized
caucaucagccucuccaa

SEQ ID NO: 3591 - RNA, 18 nt, artificial
  Chemically synthesized
ugggaaauauggacaccu

SEQ ID NO: 3592 - RNA, 18 nt, artificial
  Chemically synthesized
guugguugacuucaugga

SEQ ID NO: 3593 - RNA, 18 nt, artificial
  Chemically synthesized
gcggcugcucggcguucu

SEQ ID NO: 3594 - RNA, 18 nt, artificial
  Chemically synthesized
acaggaucaccuacauua

SEQ ID NO: 3595 - RNA, 18 nt, artificial
  Chemically synthesized
gcuucagaucuacagagc

SEQ ID NO: 3596 - RNA, 18 nt, artificial
  Chemically synthesized
gauccacaguugguugac

SEQ ID NO: 3597 - RNA, 18 nt, artificial
  Chemically synthesized
cccucuuacccauguuac

SEQ ID NO: 3598 - RNA, 18 nt, artificial
  Chemically synthesized
cugccauucucauucuuc

SEQ ID NO: 3599 - RNA, 18 nt, artificial
  Chemically synthesized
aaaacuacguggauguac

SEQ ID NO: 3600 - RNA, 18 nt, artificial
  Chemically synthesized
auugaugcuucagaucua

SEQ ID NO: 3601 - RNA, 18 nt, artificial
  Chemically synthesized
agcugucacuucucugug

SEQ ID NO: 3602 - RNA, 18 nt, artificial
  Chemically synthesized
uuuggaagcugguggcaa

SEQ ID NO: 3603 - RNA, 18 nt, artificial
  Chemically synthesized
augguaucugcaagggca

SEQ ID NO: 3604 - RNA, 18 nt, artificial
  Chemically synthesized
aaggagaccuauagugac

SEQ ID NO: 3605 - RNA, 18 nt, artificial
  Chemically synthesized
ccuaccuagcugucacuu

SEQ ID NO: 3606 - RNA, 18 nt, artificial
  Chemically synthesized
ccuccaaucaggcuucuc

SEQ ID NO: 3607 - RNA, 18 nt, artificial
  Chemically synthesized
guuacaaguuccguggaa

SEQ ID NO: 3608 - RNA, 18 nt, artificial
  Chemically synthesized
cuuccugcuaagagacuc

SEQ ID NO: 3609 - RNA, 18 nt, artificial
  Chemically synthesized
acguggauguaccgucau

SEQ ID NO: 3610 - RNA, 18 nt, artificial
  Chemically synthesized
augagaacaaugaugcug

SEQ ID NO: 3611 - RNA, 18 nt, artificial
  Chemically synthesized
gaagagugaguggugcaa

SEQ ID NO: 3612 - RNA, 18 nt, artificial
  Chemically synthesized
aaaucaguaggaaugcaa

SEQ ID NO: 3613 - RNA, 18 nt, artificial
  Chemically synthesized
ccuagcugucacuucucu

SEQ ID NO: 3614 - RNA, 18 nt, artificial
  Chemically synthesized
guaugaacuggacuucuc

SEQ ID NO: 3615 - RNA, 18 nt, artificial
  Chemically synthesized
ggaggcagcgagaaagcg

SEQ ID NO: 3616 - RNA, 18 nt, artificial
  Chemically synthesized
ggcggcugcucggcguuc

SEQ ID NO: 3617 - RNA, 18 nt, artificial
  Chemically synthesized
cgccucucggugucggaa

SEQ ID NO: 3618 - RNA, 18 nt, artificial
  Chemically synthesized
aaacugucuuugugcuuu

SEQ ID NO: 3619 - RNA, 18 nt, artificial
  Chemically synthesized
cuuugugaagagugagug

SEQ ID NO: 3620 - RNA, 18 nt, artificial
  Chemically synthesized
acagugaccuacagaggu

SEQ ID NO: 3621 - RNA, 18 nt, artificial
  Chemically synthesized
guuucuuacagugagcgg

SEQ ID NO: 3622 - RNA, 18 nt, artificial
  Chemically synthesized
ugguaauuuuagagcauc

SEQ ID NO: 3623 - RNA, 18 nt, artificial
  Chemically synthesized
ggaaacaucucuuuuuuc

SEQ ID NO: 3624 - RNA, 18 nt, artificial
  Chemically synthesized
cuccaaggaagaauccuc

SEQ ID NO: 3625 - RNA, 18 nt, artificial
  Chemically synthesized
caccaagaccuaccugga

SEQ ID NO: 3626 - RNA, 18 nt, artificial
  Chemically synthesized
acaguugguugacuucau

SEQ ID NO: 3627 - RNA, 18 nt, artificial
  Chemically synthesized
ccugcuaagagacuccuc

SEQ ID NO: 3628 - RNA, 18 nt, artificial
  Chemically synthesized
ugagcacuuuauauucac

SEQ ID NO: 3629 - RNA, 18 nt, artificial
  Chemically synthesized
caggauccaaaggagacc

SEQ ID NO: 3630 - RNA, 18 nt, artificial
  Chemically synthesized
cuugacucauuucacaca

SEQ ID NO: 3631 - RNA, 18 nt, artificial
  Chemically synthesized
gagacuccucuguggcca

SEQ ID NO: 3632 - RNA, 18 nt, artificial
  Chemically synthesized
uuuguuucuuacagugag

SEQ ID NO: 3633 - RNA, 18 nt, artificial
  Chemically synthesized
gggcucauugugcccauu

SEQ ID NO: 3634 - RNA, 18 nt, artificial
  Chemically synthesized
agacuuuggaagcuggug

SEQ ID NO: 3635 - RNA, 18 nt, artificial
  Chemically synthesized
uguccuaccuagcuguca

SEQ ID NO: 3636 - RNA, 18 nt, artificial
  Chemically synthesized
gaauacuuggaucucagu

SEQ ID NO: 3637 - RNA, 18 nt, artificial
  Chemically synthesized
gacucuccaucccaugug

SEQ ID NO: 3638 - RNA, 18 nt, artificial
  Chemically synthesized
cucucggugucggaaugu

SEQ ID NO: 3639 - RNA, 18 nt, artificial
  Chemically synthesized
gaucaccuacauuagcaa

SEQ ID NO: 3640 - RNA, 18 nt, artificial
  Chemically synthesized
uggccagaaaagaugaaa

SEQ ID NO: 3641 - RNA, 18 nt, artificial
  Chemically synthesized
augcuucagaucuacaga

SEQ ID NO: 3642 - RNA, 18 nt, artificial
  Chemically synthesized
acuucucugugcagcuga

SEQ ID NO: 3643 - RNA, 18 nt, artificial
  Chemically synthesized
cugcauucccaagacacu

SEQ ID NO: 3644 - RNA, 18 nt, artificial
  Chemically synthesized
ugcugacauccaauggaa

SEQ ID NO: 3645 - RNA, 18 nt, artificial
  Chemically synthesized
auccacuggugaaacaaa

SEQ ID NO: 3646 - RNA, 18 nt, artificial
  Chemically synthesized
ugaugcuucagaucuaca

SEQ ID NO: 3647 - RNA, 18 nt, artificial
  Chemically synthesized
acuugaaaaauucagccu

SEQ ID NO: 3648 - RNA, 18 nt, artificial
  Chemically synthesized
guggaauguuuggaacug

SEQ ID NO: 3649 - RNA, 18 nt, artificial
  Chemically synthesized
gugucuggcaugugcugu

SEQ ID NO: 3650 - RNA, 18 nt, artificial
  Chemically synthesized
auuagaguuugaugacug

SEQ ID NO: 3651 - RNA, 18 nt, artificial
  Chemically synthesized
gcggaagauaaugaacac

SEQ ID NO: 3652 - RNA, 18 nt, artificial
  Chemically synthesized
gaaauauggacaccuuca

SEQ ID NO: 3653 - RNA, 18 nt, artificial
  Chemically synthesized
accuuaugguccaggagc

SEQ ID NO: 3654 - RNA, 18 nt, artificial
  Chemically synthesized
gauucuuuuucuucccug

SEQ ID NO: 3655 - RNA, 18 nt, artificial
  Chemically synthesized
ggccaaaaggaagcccag

SEQ ID NO: 3656 - RNA, 18 nt, artificial
  Chemically synthesized
agauguuacaaguuccgu

SEQ ID NO: 3657 - RNA, 18 nt, artificial
  Chemically synthesized
caaguggaucauugacaa

SEQ ID NO: 3658 - RNA, 18 nt, artificial
  Chemically synthesized
cacaauagaggaagauuc

SEQ ID NO: 3659 - RNA, 18 nt, artificial
  Chemically synthesized
agaacccauggauauaga

SEQ ID NO: 3660 - RNA, 18 nt, artificial
  Chemically synthesized
caucugauaaugacagag

SEQ ID NO: 3661 - RNA, 18 nt, artificial
  Chemically synthesized
ucacagaagcuguaaaaa

SEQ ID NO: 3662 - RNA, 18 nt, artificial
  Chemically synthesized
gaagcuguaaaaagccuu

SEQ ID NO: 3663 - RNA, 18 nt, artificial
  Chemically synthesized
accaagaccuaccuggag

SEQ ID NO: 3664 - RNA, 18 nt, artificial
  Chemically synthesized
ugucauucuuucuuccug

SEQ ID NO: 3665 - RNA, 18 nt, artificial
  Chemically synthesized
cacuggaaauuuuagaug

SEQ ID NO: 3666 - RNA, 18 nt, artificial
  Chemically synthesized
uccaggagcuggagaacu

SEQ ID NO: 3667 - RNA, 18 nt, artificial
  Chemically synthesized
uucacuuacagaaagagu

SEQ ID NO: 3668 - RNA, 18 nt, artificial
  Chemically synthesized
ucacaaaauugcaaaucc

SEQ ID NO: 3669 - RNA, 18 nt, artificial
  Chemically synthesized
gaugacuguacccuuaau

SEQ ID NO: 3670 - RNA, 18 nt, artificial
  Chemically synthesized
ucugcaagcugcggaaga

SEQ ID NO: 3671 - RNA, 18 nt, artificial
  Chemically synthesized
cuguaaucuguagcaacu

SEQ ID NO: 3672 - RNA, 18 nt, artificial
  Chemically synthesized
ucucaaugacugugucau

SEQ ID NO: 3673 - RNA, 18 nt, artificial
  Chemically synthesized
cucuuacccauguuacua

SEQ ID NO: 3674 - RNA, 18 nt, artificial
  Chemically synthesized
ugagaaaaaagccauucc

SEQ ID NO: 3675 - RNA, 18 nt, artificial
  Chemically synthesized
cuaguugggaucuuuaug

SEQ ID NO: 3676 - RNA, 18 nt, artificial
  Chemically synthesized
auaaguugaugacucuac

SEQ ID NO: 3677 - RNA, 18 nt, artificial
  Chemically synthesized
agaauacuuggaucucag

SEQ ID NO: 3678 - RNA, 18 nt, artificial
  Chemically synthesized
uccacaguugguugacuu

SEQ ID NO: 3679 - RNA, 18 nt, artificial
  Chemically synthesized
uaaccaugaucauaaguc

SEQ ID NO: 3680 - RNA, 18 nt, artificial
  Chemically synthesized
acuguacccuuaauggag

SEQ ID NO: 3681 - RNA, 18 nt, artificial
  Chemically synthesized
guugugucuucauaagcg

SEQ ID NO: 3682 - RNA, 18 nt, artificial
  Chemically synthesized
gugcucuguuccugcuga

SEQ ID NO: 3683 - RNA, 18 nt, artificial
  Chemically synthesized
gccagcagguucaggaug

SEQ ID NO: 3684 - RNA, 18 nt, artificial
  Chemically synthesized
caccuacauuagcaacag

SEQ ID NO: 3685 - RNA, 18 nt, artificial
  Chemically synthesized
ucugagagcugcgauaaa

SEQ ID NO: 3686 - RNA, 18 nt, artificial
  Chemically synthesized
gcaagggcagcucaggau

SEQ ID NO: 3687 - RNA, 18 nt, artificial
  Chemically synthesized
cugucacuucucugugca

SEQ ID NO: 3688 - RNA, 18 nt, artificial
  Chemically synthesized
caaaaucauuuggcauca

SEQ ID NO: 3689 - RNA, 18 nt, artificial
  Chemically synthesized
cccauugcucuuucacug

SEQ ID NO: 3690 - RNA, 18 nt, artificial
  Chemically synthesized
ucugauccuucauaugaa

SEQ ID NO: 3691 - RNA, 18 nt, artificial
  Chemically synthesized
agagccacaaaacugucu

SEQ ID NO: 3692 - RNA, 18 nt, artificial
  Chemically synthesized
guggugcaaguaugaacu

SEQ ID NO: 3693 - RNA, 18 nt, artificial
  Chemically synthesized
gacacuggaaauuuuaga

SEQ ID NO: 3694 - RNA, 18 nt, artificial
  Chemically synthesized
ugccgcaacucaaagaac

SEQ ID NO: 3695 - RNA, 18 nt, artificial
  Chemically synthesized
cuggcccucucuacaaac

SEQ ID NO: 3696 - RNA, 18 nt, artificial
  Chemically synthesized
gaacccauggauauagag

SEQ ID NO: 3697 - RNA, 18 nt, artificial
  Chemically synthesized
ggauguccgccucucggu

SEQ ID NO: 3698 - RNA, 18 nt, artificial
  Chemically synthesized
cucagugaaaauuugaug

SEQ ID NO: 3699 - RNA, 18 nt, artificial
  Chemically synthesized
cacaaaacugucuuugug

SEQ ID NO: 3700 - RNA, 18 nt, artificial
  Chemically synthesized
guugaagcacuggacaau

SEQ ID NO: 3701 - RNA, 18 nt, artificial
  Chemically synthesized
gaaugcaauaacuacguu

SEQ ID NO: 3702 - RNA, 18 nt, artificial
  Chemically synthesized
gaaccuuaugguccagga

SEQ ID NO: 3703 - RNA, 18 nt, artificial
  Chemically synthesized
caaagucuugauugauug

SEQ ID NO: 3704 - RNA, 18 nt, artificial
  Chemically synthesized
gcaugugcugugcucugu

SEQ ID NO: 3705 - RNA, 18 nt, artificial
  Chemically synthesized
ugguuccuuguuuacuuu

SEQ ID NO: 3706 - RNA, 18 nt, artificial
  Chemically synthesized
caggugacugcucggagu

SEQ ID NO: 3707 - RNA, 18 nt, artificial
  Chemically synthesized
gaacuugagauugaugcu

SEQ ID NO: 3708 - RNA, 18 nt, artificial
  Chemically synthesized
agcaggaacaucugcuau

SEQ ID NO: 3709 - RNA, 18 nt, artificial
  Chemically synthesized
acaucugcuaugaugcau

SEQ ID NO: 3710 - RNA, 18 nt, artificial
  Chemically synthesized
auccacaguugguugacu

SEQ ID NO: 3711 - RNA, 18 nt, artificial
  Chemically synthesized
aacuggacuucucccauu

SEQ ID NO: 3712 - RNA, 18 nt, artificial
  Chemically synthesized
ucagaacuauccacuggu

SEQ ID NO: 3713 - RNA, 18 nt, artificial
  Chemically synthesized
uugaaaagagccacaaaa

SEQ ID NO: 3714 - RNA, 18 nt, artificial
  Chemically synthesized
agucuugaacauuuagac

SEQ ID NO: 3715 - RNA, 18 nt, artificial
  Chemically synthesized
aauccuuacaaaacccua

SEQ ID NO: 3716 - RNA, 18 nt, artificial
  Chemically synthesized
ucuccaaggaagaauccu

SEQ ID NO: 3717 - RNA, 18 nt, artificial
  Chemically synthesized
gaauccuccaaucaggcu

SEQ ID NO: 3718 - RNA, 18 nt, artificial
  Chemically synthesized
gaucuuuaaacuccauuc

SEQ ID NO: 3719 - RNA, 18 nt, artificial
  Chemically synthesized
guauccaagggaauuggu

SEQ ID NO: 3720 - RNA, 18 nt, artificial
  Chemically synthesized
uccggaggcugcauauuc

SEQ ID NO: 3721 - RNA, 18 nt, artificial
  Chemically synthesized
cuuuaaacuccauucccu

SEQ ID NO: 3722 - RNA, 18 nt, artificial
  Chemically synthesized
agaggaagauucuuuuuc

SEQ ID NO: 3723 - RNA, 18 nt, artificial
  Chemically synthesized
ugauuggccagcaaauua

SEQ ID NO: 3724 - RNA, 18 nt, artificial
  Chemically synthesized
cugagagcugcgauaaag

SEQ ID NO: 3725 - RNA, 18 nt, artificial
  Chemically synthesized
ccacuggugaaacaaauu

SEQ ID NO: 3726 - RNA, 18 nt, artificial
  Chemically synthesized
agcacacgaauacacagu

SEQ ID NO: 3727 - RNA, 18 nt, artificial
  Chemically synthesized
ccaaaacuuguugcuauu

SEQ ID NO: 3728 - RNA, 18 nt, artificial
  Chemically synthesized
gaguugguaauuuuagag

SEQ ID NO: 3729 - RNA, 18 nt, artificial
  Chemically synthesized
gcucagcgggaaggauuu

SEQ ID NO: 3730 - RNA, 18 nt, artificial
  Chemically synthesized
gaaaaucaccgaugaaag

SEQ ID NO: 3731 - RNA, 18 nt, artificial
  Chemically synthesized
cuuaagauucucaaugac

SEQ ID NO: 3732 - RNA, 18 nt, artificial
  Chemically synthesized
gacuucauggaugcagaa

SEQ ID NO: 3733 - RNA, 18 nt, artificial
  Chemically synthesized
cgcaaugguaucugcaag

SEQ ID NO: 3734 - RNA, 18 nt, artificial
  Chemically synthesized
cucuguccuaccuagcug

SEQ ID NO: 3735 - RNA, 18 nt, artificial
  Chemically synthesized
cuuucacugcuuucaacu

SEQ ID NO: 3736 - RNA, 18 nt, artificial
  Chemically synthesized
uggacuuaccuuccuuga

SEQ ID NO: 3737 - RNA, 18 nt, artificial
  Chemically synthesized
accuacauuagcaacagu

SEQ ID NO: 3738 - RNA, 18 nt, artificial
  Chemically synthesized
uucccauauuuaagacca

SEQ ID NO: 3739 - RNA, 18 nt, artificial
  Chemically synthesized
caguaaaguuuuucuggu

SEQ ID NO: 3740 - RNA, 18 nt, artificial
  Chemically synthesized
caacaacaggaucaccua

SEQ ID NO: 3741 - RNA, 18 nt, artificial
  Chemically synthesized
gagcacuuuauauucacu

SEQ ID NO: 3742 - RNA, 18 nt, artificial
  Chemically synthesized
ugaucucaagagcaacaa

SEQ ID NO: 3743 - RNA, 18 nt, artificial
  Chemically synthesized
aaguuuuucugguuccuu

SEQ ID NO: 3744 - RNA, 18 nt, artificial
  Chemically synthesized
auacugauuuggacacuu

SEQ ID NO: 3745 - RNA, 18 nt, artificial
  Chemically synthesized
gauuuggacacuuuccau

SEQ ID NO: 3746 - RNA, 18 nt, artificial
  Chemically synthesized
uggcaugugcugugcucu

SEQ ID NO: 3747 - RNA, 18 nt, artificial
  Chemically synthesized
uagagcaucugauaauga

SEQ ID NO: 3748 - RNA, 18 nt, artificial
  Chemically synthesized
gugacucccaggagcucu

SEQ ID NO: 3749 - RNA, 18 nt, artificial
  Chemically synthesized
ggaagcccaggaaagcuc

SEQ ID NO: 3750 - RNA, 18 nt, artificial
  Chemically synthesized
aaaaauucagccugugag

SEQ ID NO: 3751 - RNA, 18 nt, artificial
  Chemically synthesized
agcaacuggcuuaguuca

SEQ ID NO: 3752 - RNA, 18 nt, artificial
  Chemically synthesized
uucauaugaagcagcaua

SEQ ID NO: 3753 - RNA, 18 nt, artificial
  Chemically synthesized
cucuuuuuucucaucuca

SEQ ID NO: 3754 - RNA, 18 nt, artificial
  Chemically synthesized
cgggaugccuacugggug

SEQ ID NO: 3755 - RNA, 18 nt, artificial
  Chemically synthesized
uacacaguguaacaggcu

SEQ ID NO: 3756 - RNA, 18 nt, artificial
  Chemically synthesized
cagcacaaaugaacuuaa

SEQ ID NO: 3757 - RNA, 18 nt, artificial
  Chemically synthesized
gacacuuuccauuuuuca

SEQ ID NO: 3758 - RNA, 18 nt, artificial
  Chemically synthesized
ggacuucucccauuuccg

SEQ ID NO: 3759 - RNA, 18 nt, artificial
  Chemically synthesized
uucauucuaugccugaaa

SEQ ID NO: 3760 - RNA, 18 nt, artificial
  Chemically synthesized
caccgaugaaaguuuguu

SEQ ID NO: 3761 - RNA, 18 nt, artificial
  Chemically synthesized
agcaaauuaccuguguga

SEQ ID NO: 3762 - RNA, 18 nt, artificial
  Chemically synthesized
cuugagauugaugcuuca

SEQ ID NO: 3763 - RNA, 18 nt, artificial
  Chemically synthesized
cuuuccauuuuucagaac

SEQ ID NO: 3764 - RNA, 18 nt, artificial
  Chemically synthesized
gacugcucggaguucucc

SEQ ID NO: 3765 - RNA, 18 nt, artificial
  Chemically synthesized
gcgggacuucauuccugg

SEQ ID NO: 3766 - RNA, 18 nt, artificial
  Chemically synthesized
gagcucuuagugaccaag

SEQ ID NO: 3767 - RNA, 18 nt, artificial
  Chemically synthesized
ccgucauuugaggacuug

SEQ ID NO: 3768 - RNA, 18 nt, artificial
  Chemically synthesized
aacugguaguuguggguu

SEQ ID NO: 3769 - RNA, 18 nt, artificial
  Chemically synthesized
cuccauugaaaagagcca

SEQ ID NO: 3770 - RNA, 18 nt, artificial
  Chemically synthesized
augacagaguuauagauc

SEQ ID NO: 3771 - RNA, 18 nt, artificial
  Chemically synthesized
gcauauuuuacugcugga

SEQ ID NO: 3772 - RNA, 18 nt, artificial
  Chemically synthesized
cuggacuucucccauuuc

SEQ ID NO: 3773 - RNA, 18 nt, artificial
  Chemically synthesized
cucccagcaggaacaucu

SEQ ID NO: 3774 - RNA, 18 nt, artificial
  Chemically synthesized
cuugaggaacuugagauu

SEQ ID NO: 3775 - RNA, 18 nt, artificial
  Chemically synthesized
uggacacuuuccauuuuu

SEQ ID NO: 3776 - RNA, 18 nt, artificial
  Chemically synthesized
gguauccaagggaauugg

SEQ ID NO: 3777 - RNA, 18 nt, artificial
  Chemically synthesized
gccagauuuaaaaauugg

SEQ ID NO: 3778 - RNA, 18 nt, artificial
  Chemically synthesized
uacccuuaauggaguugg

SEQ ID NO: 3779 - RNA, 18 nt, artificial
  Chemically synthesized
cuggugaaacaaauucau

SEQ ID NO: 3780 - RNA, 18 nt, artificial
  Chemically synthesized
ugaccgcaaugguaucug

SEQ ID NO: 3781 - RNA, 18 nt, artificial
  Chemically synthesized
ccaagggaauugguugca

SEQ ID NO: 3782 - RNA, 18 nt, artificial
  Chemically synthesized
aucagccucuccaaggaa

SEQ ID NO: 3783 - RNA, 18 nt, artificial
  Chemically synthesized
uggguaaaucugagagcu

SEQ ID NO: 3784 - RNA, 18 nt, artificial
  Chemically synthesized
ugguggcaauaacuucau

SEQ ID NO: 3785 - RNA, 18 nt, artificial
  Chemically synthesized
gaaugucacaggacagca

SEQ ID NO: 3786 - RNA, 18 nt, artificial
  Chemically synthesized
acccauguuacuaguauu

SEQ ID NO: 3787 - RNA, 18 nt, artificial
  Chemically synthesized
guucauuaggaaacagca

SEQ ID NO: 3788 - RNA, 18 nt, artificial
  Chemically synthesized
cuggagauuuuuguagau

SEQ ID NO: 3789 - RNA, 18 nt, artificial
  Chemically synthesized
agcaacaacaaucucaau

SEQ ID NO: 3790 - RNA, 18 nt, artificial
  Chemically synthesized
uucauuugcuccugugaa

SEQ ID NO: 3791 - RNA, 18 nt, artificial
  Chemically synthesized
gcucauugugcccauugc

SEQ ID NO: 3792 - RNA, 18 nt, artificial
  Chemically synthesized
ccaugugcguggccagca

SEQ ID NO: 3793 - RNA, 18 nt, artificial
  Chemically synthesized
ccaccguuuccauggccu

SEQ ID NO: 3794 - RNA, 18 nt, artificial
  Chemically synthesized
ccucuccaaggaagaauc

SEQ ID NO: 3795 - RNA, 18 nt, artificial
  Chemically synthesized
ucuggugcugacauccaa

SEQ ID NO: 3796 - RNA, 18 nt, artificial
  Chemically synthesized
uccuugaggaacuugaga

SEQ ID NO: 3797 - RNA, 18 nt, artificial
  Chemically synthesized
aggugacugcucggaguu

SEQ ID NO: 3798 - RNA, 18 nt, artificial
  Chemically synthesized
caagagcaacaaggcaaa

SEQ ID NO: 3799 - RNA, 18 nt, artificial
  Chemically synthesized
gaccaagugaagguaccu

SEQ ID NO: 3800 - RNA, 18 nt, artificial
  Chemically synthesized
ccagcagguucaggaugu

SEQ ID NO: 3801 - RNA, 18 nt, artificial
  Chemically synthesized
cggugucggaaugucaca

SEQ ID NO: 3802 - RNA, 18 nt, artificial
  Chemically synthesized
agcucaggaucuuuaaac

SEQ ID NO: 3803 - RNA, 18 nt, artificial
  Chemically synthesized
caguugguugacuucaug

SEQ ID NO: 3804 - RNA, 18 nt, artificial
  Chemically synthesized
gaugacucuaccagaugc

SEQ ID NO: 3805 - RNA, 18 nt, artificial
  Chemically synthesized
auccggaggcugcauauu

SEQ ID NO: 3806 - RNA, 18 nt, artificial
  Chemically synthesized
gaagauucuuuuucuucc

SEQ ID NO: 3807 - RNA, 18 nt, artificial
  Chemically synthesized
acuggacaaugccacaua

SEQ ID NO: 3808 - RNA, 18 nt, artificial
  Chemically synthesized
aguuuuucugguuccuug

SEQ ID NO: 3809 - RNA, 18 nt, artificial
  Chemically synthesized
cuucucccauuuccgucu

SEQ ID NO: 3810 - RNA, 18 nt, artificial
  Chemically synthesized
gaugccuggcccucucua

SEQ ID NO: 3811 - RNA, 18 nt, artificial
  Chemically synthesized
guaucugcaagggcagcu

SEQ ID NO: 3812 - RNA, 18 nt, artificial
  Chemically synthesized
caugugcugugcucuguu

SEQ ID NO: 3813 - RNA, 18 nt, artificial
  Chemically synthesized
accgaugaaaguuuguuu

SEQ ID NO: 3814 - RNA, 18 nt, artificial
  Chemically synthesized
ucuuagugaccaagugaa

SEQ ID NO: 3815 - RNA, 18 nt, artificial
  Chemically synthesized
gaaccuccaggcucuggu

SEQ ID NO: 3816 - RNA, 18 nt, artificial
  Chemically synthesized
cauuccuggcaaguggau

SEQ ID NO: 3817 - RNA, 18 nt, artificial
  Chemically synthesized
uuucuuccugcuaagaga

SEQ ID NO: 3818 - RNA, 18 nt, artificial
  Chemically synthesized
gaugcugccauucucauu

SEQ ID NO: 3819 - RNA, 18 nt, artificial
  Chemically synthesized
ucagaucuacagagcuau

SEQ ID NO: 3820 - RNA, 18 nt, artificial
  Chemically synthesized
uucuaaggagcaacuuga

SEQ ID NO: 3821 - RNA, 18 nt, artificial
  Chemically synthesized
cagugaccuacagaggug

SEQ ID NO: 3822 - RNA, 18 nt, artificial
  Chemically synthesized
cuguggccacaaaaggca

SEQ ID NO: 3823 - RNA, 18 nt, artificial
  Chemically synthesized
uaugaucugagcacuuua

SEQ ID NO: 3824 - RNA, 18 nt, artificial
  Chemically synthesized
cugcucggaguucuccca

SEQ ID NO: 3825 - RNA, 18 nt, artificial
  Chemically synthesized
caauaacuucauuugcuc

SEQ ID NO: 3826 - RNA, 18 nt, artificial
  Chemically synthesized
acuucauuccuggcaagu

SEQ ID NO: 3827 - RNA, 18 nt, artificial
  Chemically synthesized
uacuuuugauccacaguu

SEQ ID NO: 3828 - RNA, 18 nt, artificial
  Chemically synthesized
ccaggagcucuuagugac

SEQ ID NO: 3829 - RNA, 18 nt, artificial
  Chemically synthesized
ucggaaugucacaggaca

SEQ ID NO: 3830 - RNA, 18 nt, artificial
  Chemically synthesized
ggagcagcaagcacuggc

SEQ ID NO: 3831 - RNA, 18 nt, artificial
  Chemically synthesized
gcuuucugaaaacuuugu

SEQ ID NO: 3832 - RNA, 18 nt, artificial
  Chemically synthesized
aaaacuuguugcuauucc

SEQ ID NO: 3833 - RNA, 18 nt, artificial
  Chemically synthesized
uagcaacagugaccuaca

SEQ ID NO: 3834 - RNA, 18 nt, artificial
  Chemically synthesized
auuugaacuuauccagca

SEQ ID NO: 3835 - RNA, 18 nt, artificial
  Chemically synthesized
cgucauuugaggacuugc

SEQ ID NO: 3836 - RNA, 18 nt, artificial
  Chemically synthesized
ucaggugacugcucggag

SEQ ID NO: 3837 - RNA, 18 nt, artificial
  Chemically synthesized
aacuggcuuaguucauua

SEQ ID NO: 3838 - RNA, 18 nt, artificial
  Chemically synthesized
gucauucuuucuuccugc

SEQ ID NO: 3839 - RNA, 18 nt, artificial
  Chemically synthesized
gugcagcugaucucaaga

SEQ ID NO: 3840 - RNA, 18 nt, artificial
  Chemically synthesized
gacuucucccauuuccgu

SEQ ID NO: 3841 - RNA, 18 nt, artificial
  Chemically synthesized
agcuguaaaaagccuuga

SEQ ID NO: 3842 - RNA, 18 nt, artificial
  Chemically synthesized
cugcuggagauuuuugua

SEQ ID NO: 3843 - RNA, 18 nt, artificial
  Chemically synthesized
aggaacuugagauugaug

SEQ ID NO: 3844 - RNA, 18 nt, artificial
  Chemically synthesized
agauugaugcuucagauc

SEQ ID NO: 3845 - RNA, 18 nt, artificial
  Chemically synthesized
cuacagaggugugugaac

SEQ ID NO: 3846 - RNA, 18 nt, artificial
  Chemically synthesized
aggagaccuauagugacu

SEQ ID NO: 3847 - RNA, 18 nt, artificial
  Chemically synthesized
uagcaacaacaaucucaa

SEQ ID NO: 3848 - RNA, 18 nt, artificial
  Chemically synthesized
gacagaguuauagaucca

SEQ ID NO: 3849 - RNA, 18 nt, artificial
  Chemically synthesized
caaugguaucugcaaggg

SEQ ID NO: 3850 - RNA, 18 nt, artificial
  Chemically synthesized
gcugccauucucauucuu

SEQ ID NO: 3851 - RNA, 18 nt, artificial
  Chemically synthesized
ccauugcucuuucacugc

SEQ ID NO: 3852 - RNA, 18 nt, artificial
  Chemically synthesized
ccucccucuuacccaugu

SEQ ID NO: 3853 - RNA, 18 nt, artificial
  Chemically synthesized
ucaucugauccuucauau

SEQ ID NO: 3854 - RNA, 18 nt, artificial
  Chemically synthesized
cauauuccaagguuuuac

SEQ ID NO: 3855 - RNA, 18 nt, artificial
  Chemically synthesized
cacugcuuucaacuggua

SEQ ID NO: 3856 - RNA, 18 nt, artificial
  Chemically synthesized
aacuacguuuucuaagga

SEQ ID NO: 3857 - RNA, 18 nt, artificial
  Chemically synthesized
cugguggcaauaacuuca

SEQ ID NO: 3858 - RNA, 18 nt, artificial
  Chemically synthesized
uguuugguguugcaagca

SEQ ID NO: 3859 - RNA, 18 nt, artificial
  Chemically synthesized
ugcuaagagacuccucug

SEQ ID NO: 3860 - RNA, 18 nt, artificial
  Chemically synthesized
aaucauuuggcaucauug

SEQ ID NO: 3861 - RNA, 18 nt, artificial
  Chemically synthesized
aauucagccugugaggau

SEQ ID NO: 3862 - RNA, 18 nt, artificial
  Chemically synthesized
guacccuuaauggaguug

SEQ ID NO: 3863 - RNA, 18 nt, artificial
  Chemically synthesized
guggauggugugggucuu

SEQ ID NO: 3864 - RNA, 18 nt, artificial
  Chemically synthesized
caggaaagcucccagcag

SEQ ID NO: 3865 - RNA, 18 nt, artificial
  Chemically synthesized
caggcucuggugcugaca

SEQ ID NO: 3866 - RNA, 18 nt, artificial
  Chemically synthesized
aaccggagagacuuugcu

SEQ ID NO: 3867 - RNA, 18 nt, artificial
  Chemically synthesized
cauucuuaaacuuacugg

SEQ ID NO: 3868 - RNA, 18 nt, artificial
  Chemically synthesized
ugcuggacuuaccuuccu

SEQ ID NO: 3869 - RNA, 18 nt, artificial
  Chemically synthesized
agccacaaaacugucuuu

SEQ ID NO: 3870 - RNA, 18 nt, artificial
  Chemically synthesized
uucuaugccugaaacuug

SEQ ID NO: 3871 - RNA, 18 nt, artificial
  Chemically synthesized
cugcuuucaacugguagu

SEQ ID NO: 3872 - RNA, 18 nt, artificial
  Chemically synthesized
cacuggugucuggcaugu

SEQ ID NO: 3873 - RNA, 18 nt, artificial
  Chemically synthesized
uacugauuuggacacuuu

SEQ ID NO: 3874 - RNA, 18 nt, artificial
  Chemically synthesized
aaaagauuuugcuggacu

SEQ ID NO: 3875 - RNA, 18 nt, artificial
  Chemically synthesized
aauugcaaauccugagag

SEQ ID NO: 3876 - RNA, 18 nt, artificial
  Chemically synthesized
gugaccgcaaugguaucu

SEQ ID NO: 3877 - RNA, 18 nt, artificial
  Chemically synthesized
gagagcugcgauaaaguc

SEQ ID NO: 3878 - RNA, 18 nt, artificial
  Chemically synthesized
gacuuuggaagcuggugg

SEQ ID NO: 3879 - RNA, 18 nt, artificial
  Chemically synthesized
gucacuucucugugcagc

SEQ ID NO: 3880 - RNA, 18 nt, artificial
  Chemically synthesized
ugacugugucauucuuuc

SEQ ID NO: 3881 - RNA, 18 nt, artificial
  Chemically synthesized
ggugugugaaccuccagg

SEQ ID NO: 3882 - RNA, 18 nt, artificial
  Chemically synthesized
aauacacaguguaacagg

SEQ ID NO: 3883 - RNA, 18 nt, artificial
  Chemically synthesized
ugcauucccaagacacug

SEQ ID NO: 3884 - RNA, 18 nt, artificial
  Chemically synthesized
auguuuggaacugcgaga

SEQ ID NO: 3885 - RNA, 18 nt, artificial
  Chemically synthesized
cugcgagauacugauuug

SEQ ID NO: 3886 - RNA, 18 nt, artificial
  Chemically synthesized
aagagugaguggugcaag

SEQ ID NO: 3887 - RNA, 18 nt, artificial
  Chemically synthesized
caucauuggaaaaaaccg

SEQ ID NO: 3888 - RNA, 18 nt, artificial
  Chemically synthesized
acuacguggauguaccgu

SEQ ID NO: 3889 - RNA, 18 nt, artificial
  Chemically synthesized
guuaaguucauucagaca

SEQ ID NO: 3890 - RNA, 18 nt, artificial
  Chemically synthesized
ggccagcaaauuaccugu

SEQ ID NO: 3891 - RNA, 18 nt, artificial
  Chemically synthesized
gaucucaagagcaacaag

SEQ ID NO: 3892 - RNA, 18 nt, artificial
  Chemically synthesized
aagugaagguaccugugg

SEQ ID NO: 3893 - RNA, 18 nt, artificial
  Chemically synthesized
uugggaucuuuaugucac

SEQ ID NO: 3894 - RNA, 18 nt, artificial
  Chemically synthesized
cuacuggguggagaaccu

SEQ ID NO: 3895 - RNA, 18 nt, artificial
  Chemically synthesized
ucuuugaauuugccgcaa

SEQ ID NO: 3896 - RNA, 18 nt, artificial
  Chemically synthesized
agauucucaaugacugug

SEQ ID NO: 3897 - RNA, 18 nt, artificial
  Chemically synthesized
accaagugaagguaccug

SEQ ID NO: 3898 - RNA, 18 nt, artificial
  Chemically synthesized
acaacaggaucaccuaca

SEQ ID NO: 3899 - RNA, 18 nt, artificial
  Chemically synthesized
guguaacaggcugcauuc

SEQ ID NO: 3900 - RNA, 18 nt, artificial
  Chemically synthesized
gcagguucaggauguccg

SEQ ID NO: 3901 - RNA, 18 nt, artificial
  Chemically synthesized
cucuccuucacucaggag

SEQ ID NO: 3902 - RNA, 18 nt, artificial
  Chemically synthesized
gucccuugguauccaagg

SEQ ID NO: 3903 - RNA, 18 nt, artificial
  Chemically synthesized
ugcuuucugaaaacuuug

SEQ ID NO: 3904 - RNA, 18 nt, artificial
  Chemically synthesized
acacaguguaacaggcug

SEQ ID NO: 3905 - RNA, 18 nt, artificial
  Chemically synthesized
aaucaccgaugaaaguuu

SEQ ID NO: 3906 - RNA, 18 nt, artificial
  Chemically synthesized
auugcucuuucacugcuu

SEQ ID NO: 3907 - RNA, 18 nt, artificial
  Chemically synthesized
gcacuggugucuggcaug

SEQ ID NO: 3908 - RNA, 18 nt, artificial
  Chemically synthesized
uguaaucuguagcaacug

SEQ ID NO: 3909 - RNA, 18 nt, artificial
  Chemically synthesized
acaaguuccguggaaugu

SEQ ID NO: 3910 - RNA, 18 nt, artificial
  Chemically synthesized
ccuggaguggcccaugga

SEQ ID NO: 3911 - RNA, 18 nt, artificial
  Chemically synthesized
uaguugggaucuuuaugu

SEQ ID NO: 3912 - RNA, 18 nt, artificial
  Chemically synthesized
cagcgcuucugcaagcug

SEQ ID NO: 3913 - RNA, 18 nt, artificial
  Chemically synthesized
ccguuuccauggccugug

SEQ ID NO: 3914 - RNA, 18 nt, artificial
  Chemically synthesized
agcacuggccaaagucuu

SEQ ID NO: 3915 - RNA, 18 nt, artificial
  Chemically synthesized
ugucggaaugucacagga

SEQ ID NO: 3916 - RNA, 18 nt, artificial
  Chemically synthesized
ucuucuggagcccauuga

SEQ ID NO: 3917 - RNA, 18 nt, artificial
  Chemically synthesized
auuuggacacuuuccauu

SEQ ID NO: 3918 - RNA, 18 nt, artificial
  Chemically synthesized
gcgggaugccuacugggu

SEQ ID NO: 3919 - RNA, 18 nt, artificial
  Chemically synthesized
aauccuccaaucaggcuu

SEQ ID NO: 3920 - RNA, 18 nt, artificial
  Chemically synthesized
acugcuuucaacugguag

SEQ ID NO: 3921 - RNA, 18 nt, artificial
  Chemically synthesized
ccuccaggcucuggugcu

SEQ ID NO: 3922 - RNA, 18 nt, artificial
  Chemically synthesized
uugcaaauccugagagug

SEQ ID NO: 3923 - RNA, 18 nt, artificial
  Chemically synthesized
gaggcucagcgggaagga

SEQ ID NO: 3924 - RNA, 18 nt, artificial
  Chemically synthesized
ucuuccugcuaagagacu

SEQ ID NO: 3925 - RNA, 18 nt, artificial
  Chemically synthesized
uuuuacugcuggagauuu

SEQ ID NO: 3926 - RNA, 18 nt, artificial
  Chemically synthesized
auacuuuguggauggugu

SEQ ID NO: 3927 - RNA, 18 nt, artificial
  Chemically synthesized
guaccgucauuugaggac

SEQ ID NO: 3928 - RNA, 18 nt, artificial
  Chemically synthesized
cagaaauaaguugaugac

SEQ ID NO: 3929 - RNA, 18 nt, artificial
  Chemically synthesized
cagcacuggugucuggca

SEQ ID NO: 3930 - RNA, 18 nt, artificial
  Chemically synthesized
cucaggagcagcaagcac

SEQ ID NO: 3931 - RNA, 18 nt, artificial
  Chemically synthesized
uugucaguggccagaaaa

SEQ ID NO: 3932 - RNA, 18 nt, artificial
  Chemically synthesized
gaagacuuuggaagcugg

SEQ ID NO: 3933 - RNA, 18 nt, artificial
  Chemically synthesized
cuuuguggaugguguggg

SEQ ID NO: 3934 - RNA, 18 nt, artificial
  Chemically synthesized
auaaugaacaccaagacc

SEQ ID NO: 3935 - RNA, 18 nt, artificial
  Chemically synthesized
aaugaacaccaagaccua

SEQ ID NO: 3936 - RNA, 18 nt, artificial
  Chemically synthesized
uccaaaggagaccuauag

SEQ ID NO: 3937 - RNA, 18 nt, artificial
  Chemically synthesized
cugggcagucuugaacau

SEQ ID NO: 3938 - RNA, 18 nt, artificial
  Chemically synthesized
uggguggagaaccuuaug

SEQ ID NO: 3939 - RNA, 18 nt, artificial
  Chemically synthesized
uguaagucaucugauccu

SEQ ID NO: 3940 - RNA, 18 nt, artificial
  Chemically synthesized
ccugugugacucuccauc

SEQ ID NO: 3941 - RNA, 18 nt, artificial
  Chemically synthesized
agaagcuguaaaaagccu

SEQ ID NO: 3942 - RNA, 18 nt, artificial
  Chemically synthesized
aacuuugugaagagugag

SEQ ID NO: 3943 - RNA, 18 nt, artificial
  Chemically synthesized
ugaugcugccauucucau

SEQ ID NO: 3944 - RNA, 18 nt, artificial
  Chemically synthesized
aauccugagagugggaaa

SEQ ID NO: 3945 - RNA, 18 nt, artificial
  Chemically synthesized
acuggacuucucccauuu

SEQ ID NO: 3946 - RNA, 18 nt, artificial
  Chemically synthesized
gaaacagcacaaaugaac

SEQ ID NO: 3947 - RNA, 18 nt, artificial
  Chemically synthesized
ugagccaaaaaguuugaa

SEQ ID NO: 3948 - RNA, 18 nt, artificial
  Chemically synthesized
ugacaauaucauugacuc

SEQ ID NO: 3949 - RNA, 18 nt, artificial
  Chemically synthesized
cgucuuccugguucaagc

SEQ ID NO: 3950 - RNA, 18 nt, artificial
  Chemically synthesized
ugcccauugcucuuucac

SEQ ID NO: 3951 - RNA, 18 nt, artificial
  Chemically synthesized
uggcaaguggaucauuga

SEQ ID NO: 3952 - RNA, 18 nt, artificial
  Chemically synthesized
guccuaccuagcugucac

SEQ ID NO: 3953 - RNA, 18 nt, artificial
  Chemically synthesized
uggcaauaacuucauuug

SEQ ID NO: 3954 - RNA, 18 nt, artificial
  Chemically synthesized
ugacucauuucacacacu

SEQ ID NO: 3955 - RNA, 18 nt, artificial
  Chemically synthesized
cguucucucaggugacug

SEQ ID NO: 3956 - RNA, 18 nt, artificial
  Chemically synthesized
aacuuguugcuauuccua

SEQ ID NO: 3957 - RNA, 18 nt, artificial
  Chemically synthesized
uuaccuuccuugaggaac

SEQ ID NO: 3958 - RNA, 18 nt, artificial
  Chemically synthesized
cuggccaaagucuugauu

SEQ ID NO: 3959 - RNA, 18 nt, artificial
  Chemically synthesized
ucaccuacauuagcaaca

SEQ ID NO: 3960 - RNA, 18 nt, artificial
  Chemically synthesized
ucauggaugcagaaccca

SEQ ID NO: 3961 - RNA, 18 nt, artificial
  Chemically synthesized
gugcugugcucuguuccu

SEQ ID NO: 3962 - RNA, 18 nt, artificial
  Chemically synthesized
aagucaucugauccuuca

SEQ ID NO: 3963 - RNA, 18 nt, artificial
  Chemically synthesized
ucauucuucuggagccca

SEQ ID NO: 3964 - RNA, 18 nt, artificial
  Chemically synthesized
aaacuuugugaagaguga

SEQ ID NO: 3965 - RNA, 18 nt, artificial
  Chemically synthesized
gccagcaaauuaccugug

SEQ ID NO: 3966 - RNA, 18 nt, artificial
  Chemically synthesized
gucauuugaggacuugcu

SEQ ID NO: 3967 - RNA, 18 nt, artificial
  Chemically synthesized
gacuucauuccuggcaag

SEQ ID NO: 3968 - RNA, 18 nt, artificial
  Chemically synthesized
gcucccagcaggaacauc

SEQ ID NO: 3969 - RNA, 18 nt, artificial
  Chemically synthesized
caaaacuuguugcuauuc

SEQ ID NO: 3970 - RNA, 18 nt, artificial
  Chemically synthesized
cucauugugcccauugcu

SEQ ID NO: 3971 - RNA, 18 nt, artificial
  Chemically synthesized
gagggccaacuguaaucu

SEQ ID NO: 3972 - RNA, 18 nt, artificial
  Chemically synthesized
acuggugucuggcaugug

SEQ ID NO: 3973 - RNA, 18 nt, artificial
  Chemically synthesized
ggaguggcccauggacga

SEQ ID NO: 3974 - RNA, 18 nt, artificial
  Chemically synthesized
gauguuacaaguuccgug

SEQ ID NO: 3975 - RNA, 18 nt, artificial
  Chemically synthesized
aggaagcccaggaaagcu

SEQ ID NO: 3976 - RNA, 18 nt, artificial
  Chemically synthesized
cagggcucacagaagcug

SEQ ID NO: 3977 - RNA, 18 nt, artificial
  Chemically synthesized
gauuggccagcaaauuac

SEQ ID NO: 3978 - RNA, 18 nt, artificial
  Chemically synthesized
uugguugacuucauggau

SEQ ID NO: 3979 - RNA, 18 nt, artificial
  Chemically synthesized
acugauuuggacacuuuc

SEQ ID NO: 3980 - RNA, 18 nt, artificial
  Chemically synthesized
gcugcgauaaaguccuag

SEQ ID NO: 3981 - RNA, 18 nt, artificial
  Chemically synthesized
cucguggauaucaaaauu

SEQ ID NO: 3982 - RNA, 18 nt, artificial
  Chemically synthesized
gucuugugaccgcaaugg

SEQ ID NO: 3983 - RNA, 18 nt, artificial
  Chemically synthesized
aguuccguggaauguuug

SEQ ID NO: 3984 - RNA, 18 nt, artificial
  Chemically synthesized
ugauuuggacacuuucca

SEQ ID NO: 3985 - RNA, 18 nt, artificial
  Chemically synthesized
caagugaagguaccugug

SEQ ID NO: 3986 - RNA, 18 nt, artificial
  Chemically synthesized
agggcagcucaggaucuu

SEQ ID NO: 3987 - RNA, 18 nt, artificial
  Chemically synthesized
cuuagugaccaagugaag

SEQ ID NO: 3988 - RNA, 18 nt, artificial
  Chemically synthesized
uuacaaguuccguggaau

SEQ ID NO: 3989 - RNA, 18 nt, artificial
  Chemically synthesized
ugagagcugcgauaaagu

SEQ ID NO: 3990 - RNA, 18 nt, artificial
  Chemically synthesized
ugaaaacuuugugaagag

SEQ ID NO: 3991 - RNA, 18 nt, artificial
  Chemically synthesized
cagaggugugugaaccuc

SEQ ID NO: 3992 - RNA, 18 nt, artificial
  Chemically synthesized
ucuucauaagcgggacuu

SEQ ID NO: 3993 - RNA, 18 nt, artificial
  Chemically synthesized
acaaaaggcauucucugu

SEQ ID NO: 3994 - RNA, 18 nt, artificial
  Chemically synthesized
ucccaguguuugguguug

SEQ ID NO: 3995 - RNA, 18 nt, artificial
  Chemically synthesized
ucugucuugugaccgcaa

SEQ ID NO: 3996 - RNA, 18 nt, artificial
  Chemically synthesized
cugugccaccguuuccau

SEQ ID NO: 3997 - RNA, 18 nt, artificial
  Chemically synthesized
cagcucaggaucuuuaaa

SEQ ID NO: 3998 - RNA, 18 nt, artificial
  Chemically synthesized
cagcauauuuuacugcug

SEQ ID NO: 3999 - RNA, 18 nt, artificial
  Chemically synthesized
aggacagcacuggugucu

SEQ ID NO: 4000 - RNA, 18 nt, artificial
  Chemically synthesized
guccaggagcuggagaac

SEQ ID NO: 4001 - RNA, 18 nt, artificial
  Chemically synthesized
ccuuaugguccaggagcu

SEQ ID NO: 4002 - RNA, 18 nt, artificial
  Chemically synthesized
acuggugaaacaaauuca

SEQ ID NO: 4003 - RNA, 18 nt, artificial
  Chemically synthesized
cuagcugucacuucucug

SEQ ID NO: 4004 - RNA, 18 nt, artificial
  Chemically synthesized
gaggugugugaaccucca

SEQ ID NO: 4005 - RNA, 18 nt, artificial
  Chemically synthesized
gguaucugcaagggcagc

SEQ ID NO: 4006 - RNA, 18 nt, artificial
  Chemically synthesized
uggaauguuuggaacugc

SEQ ID NO: 4007 - RNA, 18 nt, artificial
  Chemically synthesized
uggacaaugccacauacu

SEQ ID NO: 4008 - RNA, 18 nt, artificial
  Chemically synthesized
cuccuucacucaggagca

SEQ ID NO: 4009 - RNA, 18 nt, artificial
  Chemically synthesized
uguagcaacuggcuuagu

SEQ ID NO: 4010 - RNA, 18 nt, artificial
  Chemically synthesized
uaccuagcugucacuucu

SEQ ID NO: 4011 - RNA, 18 nt, artificial
  Chemically synthesized
ugcuaugaugcauuuguu

SEQ ID NO: 4012 - RNA, 18 nt, artificial
  Chemically synthesized
ucucugugcagcugaucu

SEQ ID NO: 4013 - RNA, 18 nt, artificial
  Chemically synthesized
auccaagggaauugguug

SEQ ID NO: 4014 - RNA, 18 nt, artificial
  Chemically synthesized
uugacuccauugaaaaga

SEQ ID NO: 4015 - RNA, 18 nt, artificial
  Chemically synthesized
gucuugauugauuggcca

SEQ ID NO: 4016 - RNA, 18 nt, artificial
  Chemically synthesized
ucauaugaagcagcauau

SEQ ID NO: 4017 - RNA, 18 nt, artificial
  Chemically synthesized
aaaaccggagagacuuug

SEQ ID NO: 4018 - RNA, 18 nt, artificial
  Chemically synthesized
gcccauggacgaggcuca

SEQ ID NO: 4019 - RNA, 18 nt, artificial
  Chemically synthesized
aauauagucccuugguau

SEQ ID NO: 4020 - RNA, 18 nt, artificial
  Chemically synthesized
caggaucuuuaaacucca

SEQ ID NO: 4021 - RNA, 18 nt, artificial
  Chemically synthesized
uauccaagggaauugguu

SEQ ID NO: 4022 - RNA, 18 nt, artificial
  Chemically synthesized
cuuacagugagcgggaug

SEQ ID NO: 4023 - RNA, 18 nt, artificial
  Chemically synthesized
ccugugccaccguuucca

SEQ ID NO: 4024 - RNA, 18 nt, artificial
  Chemically synthesized
gcucuguuccugcugauc

SEQ ID NO: 4025 - RNA, 18 nt, artificial
  Chemically synthesized
gcaaugguaucugcaagg

SEQ ID NO: 4026 - RNA, 18 nt, artificial
  Chemically synthesized
ccaaucaggcuucucugu

SEQ ID NO: 4027 - RNA, 18 nt, artificial
  Chemically synthesized
acugaagacuuuggaagc

SEQ ID NO: 4028 - RNA, 18 nt, artificial
  Chemically synthesized
ccuggcuccaggccaaaa

SEQ ID NO: 4029 - RNA, 18 nt, artificial
  Chemically synthesized
ugaaaagagccacaaaac

SEQ ID NO: 4030 - RNA, 18 nt, artificial
  Chemically synthesized
gugccaccguuuccaugg

SEQ ID NO: 4031 - RNA, 18 nt, artificial
  Chemically synthesized
ggcagcgagaaagcgcag

SEQ ID NO: 4032 - RNA, 18 nt, artificial
  Chemically synthesized
cagccugugaggaugccu

SEQ ID NO: 4033 - RNA, 18 nt, artificial
  Chemically synthesized
aggcagcgagaaagcgca

SEQ ID NO: 4034 - RNA, 18 nt, artificial
  Chemically synthesized
ggccagcagguucaggau

SEQ ID NO: 4035 - RNA, 18 nt, artificial
  Chemically synthesized
cuccugugaauuccucuc

SEQ ID NO: 4036 - RNA, 18 nt, artificial
  Chemically synthesized
uggugucuggcaugugcu

SEQ ID NO: 4037 - RNA, 18 nt, artificial
  Chemically synthesized
uugaugagaacaaugaug

SEQ ID NO: 4038 - RNA, 18 nt, artificial
  Chemically synthesized
guccugugccaccguuuc

SEQ ID NO: 4039 - RNA, 18 nt, artificial
  Chemically synthesized
cuggugucuggcaugugc

SEQ ID NO: 4040 - RNA, 18 nt, artificial
  Chemically synthesized
aggauguccgccucucgg

SEQ ID NO: 4041 - RNA, 18 nt, artificial
  Chemically synthesized
caggaacaucugcuauga

SEQ ID NO: 4042 - RNA, 18 nt, artificial
  Chemically synthesized
uccacuggugaaacaaau

SEQ ID NO: 4043 - RNA, 18 nt, artificial
  Chemically synthesized
cagccaggcggcugcucg

SEQ ID NO: 4044 - RNA, 18 nt, artificial
  Chemically synthesized
uccucuguggccacaaaa

SEQ ID NO: 4045 - RNA, 18 nt, artificial
  Chemically synthesized
uggugcaaguaugaacug

SEQ ID NO: 4046 - RNA, 18 nt, artificial
  Chemically synthesized
agggccaacuguaaucug

SEQ ID NO: 4047 - RNA, 18 nt, artificial
  Chemically synthesized
auuuuacugcuggagauu

SEQ ID NO: 4048 - RNA, 18 nt, artificial
  Chemically synthesized
caagggcagcucaggauc

SEQ ID NO: 4049 - RNA, 18 nt, artificial
  Chemically synthesized
uugugaccgcaaugguau

SEQ ID NO: 4050 - RNA, 18 nt, artificial
  Chemically synthesized
auuugcuccugugaauuc

SEQ ID NO: 4051 - RNA, 18 nt, artificial
  Chemically synthesized
gcuguaaaaagccuugac

SEQ ID NO: 4052 - RNA, 18 nt, artificial
  Chemically synthesized
cuguaaaaagccuugacc

SEQ ID NO: 4053 - RNA, 18 nt, artificial
  Chemically synthesized
ugccuacuggguggagaa

SEQ ID NO: 4054 - RNA, 18 nt, artificial
  Chemically synthesized
aaauugcaaauccugaga

SEQ ID NO: 4055 - RNA, 18 nt, artificial
  Chemically synthesized
acagaguuauagauccag

SEQ ID NO: 4056 - RNA, 18 nt, artificial
  Chemically synthesized
gaacaccaagaccuaccu

SEQ ID NO: 4057 - RNA, 18 nt, artificial
  Chemically synthesized
uucagaucuacagagcua

SEQ ID NO: 4058 - RNA, 18 nt, artificial
  Chemically synthesized
acugucuuugugcuuucu

SEQ ID NO: 4059 - RNA, 18 nt, artificial
  Chemically synthesized
ccaggaaagcucccagca

SEQ ID NO: 4060 - RNA, 18 nt, artificial
  Chemically synthesized
guucucccaguguuuggu

SEQ ID NO: 4061 - RNA, 18 nt, artificial
  Chemically synthesized
auuucacacacugaagac

SEQ ID NO: 4062 - RNA, 18 nt, artificial
  Chemically synthesized
ugguauccaagggaauug

SEQ ID NO: 4063 - RNA, 18 nt, artificial
  Chemically synthesized
cugaaacuugucaguggc

SEQ ID NO: 4064 - RNA, 18 nt, artificial
  Chemically synthesized
aaguggaaacguuaacaa

SEQ ID NO: 4065 - RNA, 18 nt, artificial
  Chemically synthesized
cagaagcuguaaaaagcc

SEQ ID NO: 4066 - RNA, 18 nt, artificial
  Chemically synthesized
ucccaagacacuggaaau

SEQ ID NO: 4067 - RNA, 18 nt, artificial
  Chemically synthesized
ugaaucagauuucuggau

SEQ ID NO: 4068 - RNA, 18 nt, artificial
  Chemically synthesized
ucacacacugaagacuuu

SEQ ID NO: 4069 - RNA, 18 nt, artificial
  Chemically synthesized
uugagaaaaaagccauuc

SEQ ID NO: 4070 - RNA, 18 nt, artificial
  Chemically synthesized
agaaaugugaaaaucacc

SEQ ID NO: 4071 - RNA, 18 nt, artificial
  Chemically synthesized
auucuucuggagcccauu

SEQ ID NO: 4072 - RNA, 18 nt, artificial
  Chemically synthesized
cuuaaacuuacugggaaa

SEQ ID NO: 4073 - RNA, 18 nt, artificial
  Chemically synthesized
uuuucuaaggagcaacuu

SEQ ID NO: 4074 - RNA, 18 nt, artificial
  Chemically synthesized
ucucccaguguuuggugu

SEQ ID NO: 4075 - RNA, 18 nt, artificial
  Chemically synthesized
agugaagguaccuguggg

SEQ ID NO: 4076 - RNA, 18 nt, artificial
  Chemically synthesized
uucauaagcgggacuuca

SEQ ID NO: 4077 - RNA, 18 nt, artificial
  Chemically synthesized
aaaagugcuguguauuuc

SEQ ID NO: 4078 - RNA, 18 nt, artificial
  Chemically synthesized
acauacuuuugauccaca

SEQ ID NO: 4079 - RNA, 18 nt, artificial
  Chemically synthesized
augccucccucuuaccca

SEQ ID NO: 4080 - RNA, 18 nt, artificial
  Chemically synthesized
aagcgggacuucauuccu

SEQ ID NO: 4081 - RNA, 18 nt, artificial
  Chemically synthesized
gaggaugccuggcccucu

SEQ ID NO: 4082 - RNA, 18 nt, artificial
  Chemically synthesized
gugcccauugcucuuuca

SEQ ID NO: 4083 - RNA, 18 nt, artificial
  Chemically synthesized
aaaagagccacaaaacug

SEQ ID NO: 4084 - RNA, 18 nt, artificial
  Chemically synthesized
aaucaggcuucucugucu

SEQ ID NO: 4085 - RNA, 18 nt, artificial
  Chemically synthesized
gacucccaggagcucuua

SEQ ID NO: 4086 - RNA, 18 nt, artificial
  Chemically synthesized
guuucagguuaugaaacu

SEQ ID NO: 4087 - RNA, 18 nt, artificial
  Chemically synthesized
cucaggaucuuuaaacuc

SEQ ID NO: 4088 - RNA, 18 nt, artificial
  Chemically synthesized
ugcugauccugcucacgg

SEQ ID NO: 4089 - RNA, 18 nt, artificial
  Chemically synthesized
ugcugccauucucauucu

SEQ ID NO: 4090 - RNA, 18 nt, artificial
  Chemically synthesized
gccauucucauucuucug

SEQ ID NO: 4091 - RNA, 18 nt, artificial
  Chemically synthesized
aaaaaccggagagacuuu

SEQ ID NO: 4092 - RNA, 18 nt, artificial
  Chemically synthesized
uuucacacacugaagacu

SEQ ID NO: 4093 - RNA, 18 nt, artificial
  Chemically synthesized
aagucuugauugauuggc

SEQ ID NO: 4094 - RNA, 18 nt, artificial
  Chemically synthesized
agauacugauuuggacac

SEQ ID NO: 4095 - RNA, 18 nt, artificial
  Chemically synthesized
acaauagaggaagauucu

SEQ ID NO: 4096 - RNA, 18 nt, artificial
  Chemically synthesized
aacuauccacuggugaaa

SEQ ID NO: 4097 - RNA, 18 nt, artificial
  Chemically synthesized
uugcaagcaggauccaaa

SEQ ID NO: 4098 - RNA, 18 nt, artificial
  Chemically synthesized
guugacuucauggaugca

SEQ ID NO: 4099 - RNA, 18 nt, artificial
  Chemically synthesized
aagauuuugcuggacuua

SEQ ID NO: 4100 - RNA, 18 nt, artificial
  Chemically synthesized
ccauggccugugguauau

SEQ ID NO: 4101 - RNA, 18 nt, artificial
  Chemically synthesized
uaguuuucauucuaugcc

SEQ ID NO: 4102 - RNA, 18 nt, artificial
  Chemically synthesized
cagcaagcacuggccaaa

SEQ ID NO: 4103 - RNA, 18 nt, artificial
  Chemically synthesized
guggccacaaaaggcauu

SEQ ID NO: 4104 - RNA, 18 nt, artificial
  Chemically synthesized
uugugaagagugaguggu

SEQ ID NO: 4105 - RNA, 18 nt, artificial
  Chemically synthesized
guuuucuaaggagcaacu

SEQ ID NO: 4106 - RNA, 18 nt, artificial
  Chemically synthesized
gcagcgagaaagcgcagc

SEQ ID NO: 4107 - RNA, 18 nt, artificial
  Chemically synthesized
ugaccaagugaagguacc

SEQ ID NO: 4108 - RNA, 18 nt, artificial
  Chemically synthesized
aaaacugucuuugugcuu

SEQ ID NO: 4109 - RNA, 18 nt, artificial
  Chemically synthesized
cuggcaugugcugugcuc

SEQ ID NO: 4110 - RNA, 18 nt, artificial
  Chemically synthesized
gagaaagcgcagccaggc

SEQ ID NO: 4111 - RNA, 18 nt, artificial
  Chemically synthesized
cacucugaaaaacuugac

SEQ ID NO: 4112 - RNA, 18 nt, artificial
  Chemically synthesized
aacuugacucauuucaca

SEQ ID NO: 4113 - RNA, 18 nt, artificial
  Chemically synthesized
cgagaaagcgcagccagg

SEQ ID NO: 4114 - RNA, 18 nt, artificial
  Chemically synthesized
gcugugcucuguuccugc

SEQ ID NO: 4115 - RNA, 18 nt, artificial
  Chemically synthesized
aagccuugaccuguccaa

SEQ ID NO: 4116 - RNA, 18 nt, artificial
  Chemically synthesized
uggacuucucccauuucc

SEQ ID NO: 4117 - RNA, 18 nt, artificial
  Chemically synthesized
aaaggaagcccaggaaag

SEQ ID NO: 4118 - RNA, 18 nt, artificial
  Chemically synthesized
uuaagaccagucuuuguc

SEQ ID NO: 4119 - RNA, 18 nt, artificial
  Chemically synthesized
gagaccuauagugacucc

SEQ ID NO: 4120 - RNA, 18 nt, artificial
  Chemically synthesized
gcguucucucaggugacu

SEQ ID NO: 4121 - RNA, 18 nt, artificial
  Chemically synthesized
aucugcaagggcagcuca

SEQ ID NO: 4122 - RNA, 18 nt, artificial
  Chemically synthesized
uccugcuaagagacuccu

SEQ ID NO: 4123 - RNA, 18 nt, artificial
  Chemically synthesized
acaguguaacaggcugca

SEQ ID NO: 4124 - RNA, 18 nt, artificial
  Chemically synthesized
aggaaugcaauaacuacg

SEQ ID NO: 4125 - RNA, 18 nt, artificial
  Chemically synthesized
ucccauauuuaagaccag

SEQ ID NO: 4126 - RNA, 18 nt, artificial
  Chemically synthesized
aucucaagagcaacaagg

SEQ ID NO: 4127 - RNA, 18 nt, artificial
  Chemically synthesized
uacauuagcaacagugac

SEQ ID NO: 4128 - RNA, 18 nt, artificial
  Chemically synthesized
ucauuugcuccugugaau

SEQ ID NO: 4129 - RNA, 18 nt, artificial
  Chemically synthesized
ugcucggcguucucucag

SEQ ID NO: 4130 - RNA, 18 nt, artificial
  Chemically synthesized
guuuuucugguuccuugu

SEQ ID NO: 4131 - RNA, 18 nt, artificial
  Chemically synthesized
uccguggaauguuuggaa

SEQ ID NO: 4132 - RNA, 18 nt, artificial
  Chemically synthesized
ucaguggccagaaaagau

SEQ ID NO: 4133 - RNA, 18 nt, artificial
  Chemically synthesized
auugguugcaggauccuc

SEQ ID NO: 4134 - RNA, 18 nt, artificial
  Chemically synthesized
uaagauucucaaugacug

SEQ ID NO: 4135 - RNA, 18 nt, artificial
  Chemically synthesized
cggaggcagcgagaaagc

SEQ ID NO: 4136 - RNA, 18 nt, artificial
  Chemically synthesized
acaaaacugucuuugugc

SEQ ID NO: 4137 - RNA, 18 nt, artificial
  Chemically synthesized
uuuggaacugcgagauac

SEQ ID NO: 4138 - RNA, 18 nt, artificial
  Chemically synthesized
aacugcgagauacugauu

SEQ ID NO: 4139 - RNA, 18 nt, artificial
  Chemically synthesized
ugaccuacagaggugugu

SEQ ID NO: 4140 - RNA, 18 nt, artificial
  Chemically synthesized
caaaacugucuuugugcu

SEQ ID NO: 4141 - RNA, 18 nt, artificial
  Chemically synthesized
acuuugugaagagugagu

SEQ ID NO: 4142 - RNA, 18 nt, artificial
  Chemically synthesized
aacaggcugcauucccaa

SEQ ID NO: 4143 - RNA, 18 nt, artificial
  Chemically synthesized
ggugucuggcaugugcug

SEQ ID NO: 4144 - RNA, 18 nt, artificial
  Chemically synthesized
gccaccguuuccauggcc

SEQ ID NO: 4145 - RNA, 18 nt, artificial
  Chemically synthesized
ugauccacaguugguuga

SEQ ID NO: 4146 - RNA, 18 nt, artificial
  Chemically synthesized
agcgcuucugcaagcugc

SEQ ID NO: 4147 - RNA, 18 nt, artificial
  Chemically synthesized
auucacuuacagaaagag

SEQ ID NO: 4148 - RNA, 18 nt, artificial
  Chemically synthesized
uuuaagaccagucuuugu

SEQ ID NO: 4149 - RNA, 18 nt, artificial
  Chemically synthesized
ucuuuaaacuccauuccc

SEQ ID NO: 4150 - RNA, 18 nt, artificial
  Chemically synthesized
cucccaggagcucuuagu

SEQ ID NO: 4151 - RNA, 18 nt, artificial
  Chemically synthesized
cagaguuauagauccagg

SEQ ID NO: 4152 - RNA, 18 nt, artificial
  Chemically synthesized
cuagaaaaaagugcugug

SEQ ID NO: 4153 - RNA, 18 nt, artificial
  Chemically synthesized
uaccgucauuugaggacu

SEQ ID NO: 4154 - RNA, 18 nt, artificial
  Chemically synthesized
acuuauccagcacacgaa

SEQ ID NO: 4155 - RNA, 18 nt, artificial
  Chemically synthesized
uguccaacaacaggauca

SEQ ID NO: 4156 - RNA, 18 nt, artificial
  Chemically synthesized
ugugaagagugaguggug

SEQ ID NO: 4157 - RNA, 18 nt, artificial
  Chemically synthesized
acccauggauauagaggg

SEQ ID NO: 4158 - RNA, 18 nt, artificial
  Chemically synthesized
caacaggaucaccuacau

SEQ ID NO: 4159 - RNA, 18 nt, artificial
  Chemically synthesized
cucuguggccacaaaagg

SEQ ID NO: 4160 - RNA, 18 nt, artificial
  Chemically synthesized
ucauaagcgggacuucau

SEQ ID NO: 4161 - RNA, 18 nt, artificial
  Chemically synthesized
aaauuuucacugagaucc

SEQ ID NO: 4162 - RNA, 18 nt, artificial
  Chemically synthesized
agaggcugaugaugaccc

SEQ ID NO: 4163 - RNA, 18 nt, artificial
  Chemically synthesized
uugccaggaaugaagucc

SEQ ID NO: 4164 - RNA, 18 nt, artificial
  Chemically synthesized
aaguuuguagagagggcc

SEQ ID NO: 4165 - RNA, 18 nt, artificial
  Chemically synthesized
aaauuuccagugucuugg

SEQ ID NO: 4166 - RNA, 18 nt, artificial
  Chemically synthesized
uugugaaaguaaacaagg

SEQ ID NO: 4167 - RNA, 18 nt, artificial
  Chemically synthesized
aaugagucaaguugcucc

SEQ ID NO: 4168 - RNA, 18 nt, artificial
  Chemically synthesized
uguuuucuacugugauuc

SEQ ID NO: 4169 - RNA, 18 nt, artificial
  Chemically synthesized
auucuuccuuggagaggc

SEQ ID NO: 4170 - RNA, 18 nt, artificial
  Chemically synthesized
uaaagaucccaacuagac

SEQ ID NO: 4171 - RNA, 18 nt, artificial
  Chemically synthesized
aauccuucccgcugagcc

SEQ ID NO: 4172 - RNA, 18 nt, artificial
  Chemically synthesized
acaucuacaaaaaucucc

SEQ ID NO: 4173 - RNA, 18 nt, artificial
  Chemically synthesized
uaggucuccuuuggaucc

SEQ ID NO: 4174 - RNA, 18 nt, artificial
  Chemically synthesized
ugucuugggaaugcagcc

SEQ ID NO: 4175 - RNA, 18 nt, artificial
  Chemically synthesized
aauacuuugccuuguugc

SEQ ID NO: 4176 - RNA, 18 nt, artificial
  Chemically synthesized
aaccuuggaauaugcagc

SEQ ID NO: 4177 - RNA, 18 nt, artificial
  Chemically synthesized
acuguaagaaacaaaugc

SEQ ID NO: 4178 - RNA, 18 nt, artificial
  Chemically synthesized
ucugguagagucaucaac

SEQ ID NO: 4179 - RNA, 18 nt, artificial
  Chemically synthesized
ugauuggaggauucuucc

SEQ ID NO: 4180 - RNA, 18 nt, artificial
  Chemically synthesized
gucucuccgguuuuuucc

SEQ ID NO: 4181 - RNA, 18 nt, artificial
  Chemically synthesized
cuagugacauaaagaucc

SEQ ID NO: 4182 - RNA, 18 nt, artificial
  Chemically synthesized
acuagacaaagacugguc

SEQ ID NO: 4183 - RNA, 18 nt, artificial
  Chemically synthesized
uucucaucaaaaagacgg

SEQ ID NO: 4184 - RNA, 18 nt, artificial
  Chemically synthesized
auagacuuaugaucaugg

SEQ ID NO: 4185 - RNA, 18 nt, artificial
  Chemically synthesized
aauggaguuuaaagaucc

SEQ ID NO: 4186 - RNA, 18 nt, artificial
  Chemically synthesized
aaacacugggagaacucc

SEQ ID NO: 4187 - RNA, 18 nt, artificial
  Chemically synthesized
uugcaacaccaaacacug

SEQ ID NO: 4188 - RNA, 18 nt, artificial
  Chemically synthesized
ccaacuagacaaagacug

SEQ ID NO: 4189 - RNA, 18 nt, artificial
  Chemically synthesized
accauaagguucuccacc

SEQ ID NO: 4190 - RNA, 18 nt, artificial
  Chemically synthesized
auccugcaaccaauuccc

SEQ ID NO: 4191 - RNA, 18 nt, artificial
  Chemically synthesized
aacacugggagaacuccg

SEQ ID NO: 4192 - RNA, 18 nt, artificial
  Chemically synthesized
auacuugcaccacucacu

SEQ ID NO: 4193 - RNA, 18 nt, artificial
  Chemically synthesized
cuucaacccacaacuacc

SEQ ID NO: 4194 - RNA, 18 nt, artificial
  Chemically synthesized
cacugacaaguuucaggc

SEQ ID NO: 4195 - RNA, 18 nt, artificial
  Chemically synthesized
aauugagauuguuguugc

SEQ ID NO: 4196 - RNA, 18 nt, artificial
  Chemically synthesized
ugauauugucaaugaucc

SEQ ID NO: 4197 - RNA, 18 nt, artificial
  Chemically synthesized
aucagaugacuuacauuc

SEQ ID NO: 4198 - RNA, 18 nt, artificial
  Chemically synthesized
uugaaguucuccagcucc

SEQ ID NO: 4199 - RNA, 18 nt, artificial
  Chemically synthesized
uaaauguucaagacugcc

SEQ ID NO: 4200 - RNA, 18 nt, artificial
  Chemically synthesized
agugagcaaagucucucc

SEQ ID NO: 4201 - RNA, 18 nt, artificial
  Chemically synthesized
uauugucaaugauccacu

SEQ ID NO: 4202 - RNA, 18 nt, artificial
  Chemically synthesized
ucaaaugacgguacaucc

SEQ ID NO: 4203 - RNA, 18 nt, artificial
  Chemically synthesized
uuaccaacuccauuaagg

SEQ ID NO: 4204 - RNA, 18 nt, artificial
  Chemically synthesized
augccaaaugauuuugcc

SEQ ID NO: 4205 - RNA, 18 nt, artificial
  Chemically synthesized
agaaugacacagucauug

SEQ ID NO: 4206 - RNA, 18 nt, artificial
  Chemically synthesized
ucccaacuagacaaagac

SEQ ID NO: 4207 - RNA, 18 nt, artificial
  Chemically synthesized
uuuuuucucaaugggcuc

SEQ ID NO: 4208 - RNA, 18 nt, artificial
  Chemically synthesized
guuuuguaaggauuuccc

SEQ ID NO: 4209 - RNA, 18 nt, artificial
  Chemically synthesized
aaucaaucaagacuuugg

SEQ ID NO: 4210 - RNA, 18 nt, artificial
  Chemically synthesized
cugauuggaggauucuuc

SEQ ID NO: 4211 - RNA, 18 nt, artificial
  Chemically synthesized
uuugaaucuuagugaagg

SEQ ID NO: 4212 - RNA, 18 nt, artificial
  Chemically synthesized
agacuggucuuaaauaug

SEQ ID NO: 4213 - RNA, 18 nt, artificial
  Chemically synthesized
uggaccauaagguucucc

SEQ ID NO: 4214 - RNA, 18 nt, artificial
  Chemically synthesized
uccaaaucaguaucucgc

SEQ ID NO: 4215 - RNA, 18 nt, artificial
  Chemically synthesized
auuccgacaccgagaggc

SEQ ID NO: 4216 - RNA, 18 nt, artificial
  Chemically synthesized
ugaagucaaccaacugug

SEQ ID NO: 4217 - RNA, 18 nt, artificial
  Chemically synthesized
agugaaagagcaaugggc

SEQ ID NO: 4218 - RNA, 18 nt, artificial
  Chemically synthesized
uuuucacugagauccaag

SEQ ID NO: 4219 - RNA, 18 nt, artificial
  Chemically synthesized
agagaaugccuuuugugg

SEQ ID NO: 4220 - RNA, 18 nt, artificial
  Chemically synthesized
ugaaaguaaacaaggaac

SEQ ID NO: 4221 - RNA, 18 nt, artificial
  Chemically synthesized
uuuucagaaagcacaaag

SEQ ID NO: 4222 - RNA, 18 nt, artificial
  Chemically synthesized
agaauggcagcaucauug

SEQ ID NO: 4223 - RNA, 18 nt, artificial
  Chemically synthesized
uagguaggacagagaaug

SEQ ID NO: 4224 - RNA, 18 nt, artificial
  Chemically synthesized
uucauacuugcaccacuc

SEQ ID NO: 4225 - RNA, 18 nt, artificial
  Chemically synthesized
ucaguaucucgcaguucc

SEQ ID NO: 4226 - RNA, 18 nt, artificial
  Chemically synthesized
ucuaaauguucaagacug

SEQ ID NO: 4227 - RNA, 18 nt, artificial
  Chemically synthesized
cagcucucagauuuaccc

SEQ ID NO: 4228 - RNA, 18 nt, artificial
  Chemically synthesized
cucaaggaagguaagucc

SEQ ID NO: 4229 - RNA, 18 nt, artificial
  Chemically synthesized
auagcaacaaguuuuggg

SEQ ID NO: 4230 - RNA, 18 nt, artificial
  Chemically synthesized
guuuuaguaagcaagucc

SEQ ID NO: 4231 - RNA, 18 nt, artificial
  Chemically synthesized
uaucucgcaguuccaaac

SEQ ID NO: 4232 - RNA, 18 nt, artificial
  Chemically synthesized
ucuucacaaaguuuucag

SEQ ID NO: 4233 - RNA, 18 nt, artificial
  Chemically synthesized
aaaccuuggaauaugcag

SEQ ID NO: 4234 - RNA, 18 nt, artificial
  Chemically synthesized
uguucauuaucuuccgca

SEQ ID NO: 4235 - RNA, 18 nt, artificial
  Chemically synthesized
ccauaagguucuccaccc

SEQ ID NO: 4236 - RNA, 18 nt, artificial
  Chemically synthesized
acugggagaacuccgagc

SEQ ID NO: 4237 - RNA, 18 nt, artificial
  Chemically synthesized
caaugggcacaaugagcc

SEQ ID NO: 4238 - RNA, 18 nt, artificial
  Chemically synthesized
accuuggaauaugcagcc

SEQ ID NO: 4239 - RNA, 18 nt, artificial
  Chemically synthesized
uugcagauaccauugcgg

SEQ ID NO: 4240 - RNA, 18 nt, artificial
  Chemically synthesized
agaggagucucuuagcag

SEQ ID NO: 4241 - RNA, 18 nt, artificial
  Chemically synthesized
aauccagaaaucugauuc

SEQ ID NO: 4242 - RNA, 18 nt, artificial
  Chemically synthesized
uacacagcacuuuuuucu

SEQ ID NO: 4243 - RNA, 18 nt, artificial
  Chemically synthesized
uuguguuaauuccauugg

SEQ ID NO: 4244 - RNA, 18 nt, artificial
  Chemically synthesized
aaguauucuucaaccauc

SEQ ID NO: 4245 - RNA, 18 nt, artificial
  Chemically synthesized
ucuaaaauuaccaacucc

SEQ ID NO: 4246 - RNA, 18 nt, artificial
  Chemically synthesized
ucuguaggucacuguugc

SEQ ID NO: 4247 - RNA, 18 nt, artificial
  Chemically synthesized
auauuucccacucucagg

SEQ ID NO: 4248 - RNA, 18 nt, artificial
  Chemically synthesized
agaacuccgagcagucac

SEQ ID NO: 4249 - RNA, 18 nt, artificial
  Chemically synthesized
ugaaggagaggaauucac

SEQ ID NO: 4250 - RNA, 18 nt, artificial
  Chemically synthesized
aucaaucaagacuuuggc

SEQ ID NO: 4251 - RNA, 18 nt, artificial
  Chemically synthesized
auggcagcaucauuguuc

SEQ ID NO: 4252 - RNA, 18 nt, artificial
  Chemically synthesized
cuuccaaagucuucagug

SEQ ID NO: 4253 - RNA, 18 nt, artificial
  Chemically synthesized
acuggucuuaaauauggg

SEQ ID NO: 4254 - RNA, 18 nt, artificial
  Chemically synthesized
uaaaguucuuugaguugc

SEQ ID NO: 4255 - RNA, 18 nt, artificial
  Chemically synthesized
uuguccagugcuucaacc

SEQ ID NO: 4256 - RNA, 18 nt, artificial
  Chemically synthesized
aaacuuuuuggcucauag

SEQ ID NO: 4257 - RNA, 18 nt, artificial
  Chemically synthesized
ucugaagcaucaaucuca

SEQ ID NO: 4258 - RNA, 18 nt, artificial
  Chemically synthesized
ugaaaugagucaaguugc

SEQ ID NO: 4259 - RNA, 18 nt, artificial
  Chemically synthesized
uuuuuggcucauagcucu

SEQ ID NO: 4260 - RNA, 18 nt, artificial
  Chemically synthesized
uacuuugccuuguugcuc

SEQ ID NO: 4261 - RNA, 18 nt, artificial
  Chemically synthesized
aaaugaaguuauugccac

SEQ ID NO: 4262 - RNA, 18 nt, artificial
  Chemically synthesized
gaacuccgagcagucacc

SEQ ID NO: 4263 - RNA, 18 nt, artificial
  Chemically synthesized
agaaguccaguucauacu

SEQ ID NO: 4264 - RNA, 18 nt, artificial
  Chemically synthesized
aaguauguggcauugucc

SEQ ID NO: 4265 - RNA, 18 nt, artificial
  Chemically synthesized
uauuucaucuuuucuggc

SEQ ID NO: 4266 - RNA, 18 nt, artificial
  Chemically synthesized
aaaguuuucagaaagcac

SEQ ID NO: 4267 - RNA, 18 nt, artificial
  Chemically synthesized
uacagauuacaguuggcc

SEQ ID NO: 4268 - RNA, 18 nt, artificial
  Chemically synthesized
gcaucaaucucaaguucc

SEQ ID NO: 4269 - RNA, 18 nt, artificial
  Chemically synthesized
aauaugggaaccuaggac

SEQ ID NO: 4270 - RNA, 18 nt, artificial
  Chemically synthesized
ucuacaaaaaucuccagc

SEQ ID NO: 4271 - RNA, 18 nt, artificial
  Chemically synthesized
aguucuuugaguugcggc

SEQ ID NO: 4272 - RNA, 18 nt, artificial
  Chemically synthesized
aauguucaagacugccca

SEQ ID NO: 4273 - RNA, 18 nt, artificial
  Chemically synthesized
gucaucaaacucuaauuc

SEQ ID NO: 4274 - RNA, 18 nt, artificial
  Chemically synthesized
cuuuuuucucaaugggcu

SEQ ID NO: 4275 - RNA, 18 nt, artificial
  Chemically synthesized
caacuagacaaagacugg

SEQ ID NO: 4276 - RNA, 18 nt, artificial
  Chemically synthesized
aagacacaacuugaaggg

SEQ ID NO: 4277 - RNA, 18 nt, artificial
  Chemically synthesized
uggcuuuuuucucaaugg

SEQ ID NO: 4278 - RNA, 18 nt, artificial
  Chemically synthesized
gauccugcaaccaauucc

SEQ ID NO: 4279 - RNA, 18 nt, artificial
  Chemically synthesized
aaguuuucagaaagcaca

SEQ ID NO: 4280 - RNA, 18 nt, artificial
  Chemically synthesized
gagugagcaaagucucuc

SEQ ID NO: 4281 - RNA, 18 nt, artificial
  Chemically synthesized
acuuggucacuaagagcu

SEQ ID NO: 4282 - RNA, 18 nt, artificial
  Chemically synthesized
acuccagguaggucuugg

SEQ ID NO: 4283 - RNA, 18 nt, artificial
  Chemically synthesized
uuuuuuccaaugaugcca

SEQ ID NO: 4284 - RNA, 18 nt, artificial
  Chemically synthesized
acuauaggucuccuuugg

SEQ ID NO: 4285 - RNA, 18 nt, artificial
  Chemically synthesized
guacagucaucaaacucu

SEQ ID NO: 4286 - RNA, 18 nt, artificial
  Chemically synthesized
uuuucauauaccacaggc

SEQ ID NO: 4287 - RNA, 18 nt, artificial
  Chemically synthesized
uguuaauuccauuggaug

SEQ ID NO: 4288 - RNA, 18 nt, artificial
  Chemically synthesized
ugacauaaagaucccaac

SEQ ID NO: 4289 - RNA, 18 nt, artificial
  Chemically synthesized
aaguaaacaaggaaccag

SEQ ID NO: 4290 - RNA, 18 nt, artificial
  Chemically synthesized
aaccuaggacuuuaucgc

SEQ ID NO: 4291 - RNA, 18 nt, artificial
  Chemically synthesized
auaagguucuccacccag

SEQ ID NO: 4292 - RNA, 18 nt, artificial
  Chemically synthesized
uagugacauaaagauccc

SEQ ID NO: 4293 - RNA, 18 nt, artificial
  Chemically synthesized
aaugauccacuugccagg

SEQ ID NO: 4294 - RNA, 18 nt, artificial
  Chemically synthesized
cucuauuguguuaauucc

SEQ ID NO: 4295 - RNA, 18 nt, artificial
  Chemically synthesized
cuuacauucugaauugac

SEQ ID NO: 4296 - RNA, 18 nt, artificial
  Chemically synthesized
auggcuuuuuucucaaug

SEQ ID NO: 4297 - RNA, 18 nt, artificial
  Chemically synthesized
augcagccuguuacacug

SEQ ID NO: 4298 - RNA, 18 nt, artificial
  Chemically synthesized
caucauagcagauguucc

SEQ ID NO: 4299 - RNA, 18 nt, artificial
  Chemically synthesized
ucuccuuuggauccugcu

SEQ ID NO: 4300 - RNA, 18 nt, artificial
  Chemically synthesized
gagucacuauaggucucc

SEQ ID NO: 4301 - RNA, 18 nt, artificial
  Chemically synthesized
gagccuggagguucacac

SEQ ID NO: 4302 - RNA, 18 nt, artificial
  Chemically synthesized
uauauccauggguucugc

SEQ ID NO: 4303 - RNA, 18 nt, artificial
  Chemically synthesized
uauaggucuccuuuggau

SEQ ID NO: 4304 - RNA, 18 nt, artificial
  Chemically synthesized
cuuuuuggcucauagcuc

SEQ ID NO: 4305 - RNA, 18 nt, artificial
  Chemically synthesized
gugucuugggaaugcagc

SEQ ID NO: 4306 - RNA, 18 nt, artificial
  Chemically synthesized
ucuuaaguucauuugugc

SEQ ID NO: 4307 - RNA, 18 nt, artificial
  Chemically synthesized
auguuaaagaagaaaggg

SEQ ID NO: 4308 - RNA, 18 nt, artificial
  Chemically synthesized
uaccaagggacuauauuc

SEQ ID NO: 4309 - RNA, 18 nt, artificial
  Chemically synthesized
cuagacaaagacuggucu

SEQ ID NO: 4310 - RNA, 18 nt, artificial
  Chemically synthesized
gugcuucaacccacaacu

SEQ ID NO: 4311 - RNA, 18 nt, artificial
  Chemically synthesized
gcaaaugaaguuauugcc

SEQ ID NO: 4312 - RNA, 18 nt, artificial
  Chemically synthesized
uuggaggauucuuccuug

SEQ ID NO: 4313 - RNA, 18 nt, artificial
  Chemically synthesized
acaaagacaguuuugugg

SEQ ID NO: 4314 - RNA, 18 nt, artificial
  Chemically synthesized
aaugaaguuauugccacc

SEQ ID NO: 4315 - RNA, 18 nt, artificial
  Chemically synthesized
uaguuauugcauuccuac

SEQ ID NO: 4316 - RNA, 18 nt, artificial
  Chemically synthesized
ucacaagacagagaagcc

SEQ ID NO: 4317 - RNA, 18 nt, artificial
  Chemically synthesized
uugaaagcagugaaagag

SEQ ID NO: 4318 - RNA, 18 nt, artificial
  Chemically synthesized
aaaugagucaaguugcuc

SEQ ID NO: 4319 - RNA, 18 nt, artificial
  Chemically synthesized
uccuuuggauccugcuug

SEQ ID NO: 4320 - RNA, 18 nt, artificial
  Chemically synthesized
cucuaauucuaacaaucc

SEQ ID NO: 4321 - RNA, 18 nt, artificial
  Chemically synthesized
auaugggaaccuaggacu

SEQ ID NO: 4322 - RNA, 18 nt, artificial
  Chemically synthesized
agcaaaugaaguuauugc

SEQ ID NO: 4323 - RNA, 18 nt, artificial
  Chemically synthesized
aaacgguggcacaggacc

SEQ ID NO: 4324 - RNA, 18 nt, artificial
  Chemically synthesized
ugaauuuugauauccacg

SEQ ID NO: 4325 - RNA, 18 nt, artificial
  Chemically synthesized
ugagcaaagucucuccgg

SEQ ID NO: 4326 - RNA, 18 nt, artificial
  Chemically synthesized
aaugcagccuguuacacu

SEQ ID NO: 4327 - RNA, 18 nt, artificial
  Chemically synthesized
uuauugccaccagcuucc

SEQ ID NO: 4328 - RNA, 18 nt, artificial
  Chemically synthesized
uacuugcaccacucacuc

SEQ ID NO: 4329 - RNA, 18 nt, artificial
  Chemically synthesized
uucagugugugaaaugag

SEQ ID NO: 4330 - RNA, 18 nt, artificial
  Chemically synthesized
agagaagccugauuggag

SEQ ID NO: 4331 - RNA, 18 nt, artificial
  Chemically synthesized
aagguguccauauuuccc

SEQ ID NO: 4332 - RNA, 18 nt, artificial
  Chemically synthesized
ucacuaagagcuccuggg

SEQ ID NO: 4333 - RNA, 18 nt, artificial
  Chemically synthesized
uuggucacuaagagcucc

SEQ ID NO: 4334 - RNA, 18 nt, artificial
  Chemically synthesized
ucuugggaaugcagccug

SEQ ID NO: 4335 - RNA, 18 nt, artificial
  Chemically synthesized
aaucuuagugaagguguc

SEQ ID NO: 4336 - RNA, 18 nt, artificial
  Chemically synthesized
uuggaauaugcagccucc

SEQ ID NO: 4337 - RNA, 18 nt, artificial
  Chemically synthesized
uccauuaaggguacaguc

SEQ ID NO: 4338 - RNA, 18 nt, artificial
  Chemically synthesized
ucuugguguucauuaucu

SEQ ID NO: 4339 - RNA, 18 nt, artificial
  Chemically synthesized
cugauaucaauguuaguc

SEQ ID NO: 4340 - RNA, 18 nt, artificial
  Chemically synthesized
gauuugcaauuuugugag

SEQ ID NO: 4341 - RNA, 18 nt, artificial
  Chemically synthesized
guaaguccagcaaaaucu

SEQ ID NO: 4342 - RNA, 18 nt, artificial
  Chemically synthesized
aucuuagugaaggugucc

SEQ ID NO: 4343 - RNA, 18 nt, artificial
  Chemically synthesized
acaaaugcaucauagcag

SEQ ID NO: 4344 - RNA, 18 nt, artificial
  Chemically synthesized
uaaaaccuuggaauaugc

SEQ ID NO: 4345 - RNA, 18 nt, artificial
  Chemically synthesized
gguuuuguaaggauuucc

SEQ ID NO: 4346 - RNA, 18 nt, artificial
  Chemically synthesized
aguccaguucauacuugc

SEQ ID NO: 4347 - RNA, 18 nt, artificial
  Chemically synthesized
agucuaaauguucaagac

SEQ ID NO: 4348 - RNA, 18 nt, artificial
  Chemically synthesized
uuuccuaaugaacuaagc

SEQ ID NO: 4349 - RNA, 18 nt, artificial
  Chemically synthesized
cacagaggagucucuuag

SEQ ID NO: 4350 - RNA, 18 nt, artificial
  Chemically synthesized
gagaaugccuuuuguggc

SEQ ID NO: 4351 - RNA, 18 nt, artificial
  Chemically synthesized
gaagaaaaagaaucuucc

SEQ ID NO: 4352 - RNA, 18 nt, artificial
  Chemically synthesized
uucuccagcuccuggacc

SEQ ID NO: 4353 - RNA, 18 nt, artificial
  Chemically synthesized
acucugucauuaucagau

SEQ ID NO: 4354 - RNA, 18 nt, artificial
  Chemically synthesized
auugaaguucuccagcuc

SEQ ID NO: 4355 - RNA, 18 nt, artificial
  Chemically synthesized
agaggaauucacaggagc

SEQ ID NO: 4356 - RNA, 18 nt, artificial
  Chemically synthesized
aggcggacauccugaacc

SEQ ID NO: 4357 - RNA, 18 nt, artificial
  Chemically synthesized
gugagcaaagucucuccg

SEQ ID NO: 4358 - RNA, 18 nt, artificial
  Chemically synthesized
cuuuuuacagcuucugug

SEQ ID NO: 4359 - RNA, 18 nt, artificial
  Chemically synthesized
ccacugacaaguuucagg

SEQ ID NO: 4360 - RNA, 18 nt, artificial
  Chemically synthesized
gucacaagacagagaagc

SEQ ID NO: 4361 - RNA, 18 nt, artificial
  Chemically synthesized
uaggaaauacacagcacu

SEQ ID NO: 4362 - RNA, 18 nt, artificial
  Chemically synthesized
aggagaggaauucacagg

SEQ ID NO: 4363 - RNA, 18 nt, artificial
  Chemically synthesized
guuauugcauuccuacug

SEQ ID NO: 4364 - RNA, 18 nt, artificial
  Chemically synthesized
aagacaguuuuguggcuc

SEQ ID NO: 4365 - RNA, 18 nt, artificial
  Chemically synthesized
gguucuccacccaguagg

SEQ ID NO: 4366 - RNA, 18 nt, artificial
  Chemically synthesized
aucucaaguuccucaagg

SEQ ID NO: 4367 - RNA, 18 nt, artificial
  Chemically synthesized
uuugcuggccaaucaauc

SEQ ID NO: 4368 - RNA, 18 nt, artificial
  Chemically synthesized
ucacuguugcuaauguag

SEQ ID NO: 4369 - RNA, 18 nt, artificial
  Chemically synthesized
aaaugacgguacauccac

SEQ ID NO: 4370 - RNA, 18 nt, artificial
  Chemically synthesized
aaacaaaugcaucauagc

SEQ ID NO: 4371 - RNA, 18 nt, artificial
  Chemically synthesized
uccaguucauacuugcac

SEQ ID NO: 4372 - RNA, 18 nt, artificial
  Chemically synthesized
aggguacagucaucaaac

SEQ ID NO: 4373 - RNA, 18 nt, artificial
  Chemically synthesized
cuguuacacuguguauuc

SEQ ID NO: 4374 - RNA, 18 nt, artificial
  Chemically synthesized
agucucuccgguuuuuuc

SEQ ID NO: 4375 - RNA, 18 nt, artificial
  Chemically synthesized
uuuuaguaagcaaguccu

SEQ ID NO: 4376 - RNA, 18 nt, artificial
  Chemically synthesized
ucuccagcaguaaaauau

SEQ ID NO: 4377 - RNA, 18 nt, artificial
  Chemically synthesized
auauugucaaugauccac

SEQ ID NO: 4378 - RNA, 18 nt, artificial
  Chemically synthesized
ucaucaacuuauuucugg

SEQ ID NO: 4379 - RNA, 18 nt, artificial
  Chemically synthesized
acuagugacauaaagauc

SEQ ID NO: 4380 - RNA, 18 nt, artificial
  Chemically synthesized
auuggaggauucuuccuu

SEQ ID NO: 4381 - RNA, 18 nt, artificial
  Chemically synthesized
gucuccuuuggauccugc

SEQ ID NO: 4382 - RNA, 18 nt, artificial
  Chemically synthesized
uugguguucauuaucuuc

SEQ ID NO: 4383 - RNA, 18 nt, artificial
  Chemically synthesized
ugaauauaaagugcucag

SEQ ID NO: 4384 - RNA, 18 nt, artificial
  Chemically synthesized
auacuuugccuuguugcu

SEQ ID NO: 4385 - RNA, 18 nt, artificial
  Chemically synthesized
aaaucaguaucucgcagu

SEQ ID NO: 4386 - RNA, 18 nt, artificial
  Chemically synthesized
gauugaaguucuccagcu

SEQ ID NO: 4387 - RNA, 18 nt, artificial
  Chemically synthesized
gacuggucuuaaauaugg

SEQ ID NO: 4388 - RNA, 18 nt, artificial
  Chemically synthesized
uuaugaagacacaacuug

SEQ ID NO: 4389 - RNA, 18 nt, artificial
  Chemically synthesized
aaggagaggaauucacag

SEQ ID NO: 4390 - RNA, 18 nt, artificial
  Chemically synthesized
cuugcaacaccaaacacu

SEQ ID NO: 4391 - RNA, 18 nt, artificial
  Chemically synthesized
auauaaagugcucagauc

SEQ ID NO: 4392 - RNA, 18 nt, artificial
  Chemically synthesized
guaccuucacuuggucac

SEQ ID NO: 4393 - RNA, 18 nt, artificial
  Chemically synthesized
uucugugagcccugaggg

SEQ ID NO: 4394 - RNA, 18 nt, artificial
  Chemically synthesized
caaacacugggagaacuc

SEQ ID NO: 4395 - RNA, 18 nt, artificial
  Chemically synthesized
gggauugaaguucuccag

SEQ ID NO: 4396 - RNA, 18 nt, artificial
  Chemically synthesized
aucaugguuaucucauag

SEQ ID NO: 4397 - RNA, 18 nt, artificial
  Chemically synthesized
caacuaccaguugaaagc

SEQ ID NO: 4398 - RNA, 18 nt, artificial
  Chemically synthesized
cugcuugcaacaccaaac

SEQ ID NO: 4399 - RNA, 18 nt, artificial
  Chemically synthesized
auccacaaaguauguggc

SEQ ID NO: 4400 - RNA, 18 nt, artificial
  Chemically synthesized
cuucaaacuuuuuggcuc

SEQ ID NO: 4401 - RNA, 18 nt, artificial
  Chemically synthesized
cauccacaaaguaugugg

SEQ ID NO: 4402 - RNA, 18 nt, artificial
  Chemically synthesized
accaucaaauuuucacug

SEQ ID NO: 4403 - RNA, 18 nt, artificial
  Chemically synthesized
acacagguaauuugcugg

SEQ ID NO: 4404 - RNA, 18 nt, artificial
  Chemically synthesized
caggcugaauuuuucaag

SEQ ID NO: 4405 - RNA, 18 nt, artificial
  Chemically synthesized
aggauuugcaauuuugug

SEQ ID NO: 4406 - RNA, 18 nt, artificial
  Chemically synthesized
auugcggucacaagacag

SEQ ID NO: 4407 - RNA, 18 nt, artificial
  Chemically synthesized
caucugguagagucauca

SEQ ID NO: 4408 - RNA, 18 nt, artificial
  Chemically synthesized
augaacuaagccaguugc

SEQ ID NO: 4409 - RNA, 18 nt, artificial
  Chemically synthesized
agaaugccuuuuguggcc

SEQ ID NO: 4410 - RNA, 18 nt, artificial
  Chemically synthesized
uauccacgaggauccugc

SEQ ID NO: 4411 - RNA, 18 nt, artificial
  Chemically synthesized
cucaaaugacgguacauc

SEQ ID NO: 4412 - RNA, 18 nt, artificial
  Chemically synthesized
acacugggagaacuccga

SEQ ID NO: 4413 - RNA, 18 nt, artificial
  Chemically synthesized
uuuuguaaggauuuccca

SEQ ID NO: 4414 - RNA, 18 nt, artificial
  Chemically synthesized
auggguucugcauccaug

SEQ ID NO: 4415 - RNA, 18 nt, artificial
  Chemically synthesized
cagcuuccaaagucuuca

SEQ ID NO: 4416 - RNA, 18 nt, artificial
  Chemically synthesized
uccauggguucugcaucc

SEQ ID NO: 4417 - RNA, 18 nt, artificial
  Chemically synthesized
acacagucauugagaauc

SEQ ID NO: 4418 - RNA, 18 nt, artificial
  Chemically synthesized
acuucaaacuuuuuggcu

SEQ ID NO: 4419 - RNA, 18 nt, artificial
  Chemically synthesized
aucugaagcaucaaucuc

SEQ ID NO: 4420 - RNA, 18 nt, artificial
  Chemically synthesized
agaugcucuaaaauuacc

SEQ ID NO: 4421 - RNA, 18 nt, artificial
  Chemically synthesized
uuuacccaaaauccuucc

SEQ ID NO: 4422 - RNA, 18 nt, artificial
  Chemically synthesized
ucugucauuaucagaugc

SEQ ID NO: 4423 - RNA, 18 nt, artificial
  Chemically synthesized
auuguuguugcuaacauc

SEQ ID NO: 4424 - RNA, 18 nt, artificial
  Chemically synthesized
augggagaaguccaguuc

SEQ ID NO: 4425 - RNA, 18 nt, artificial
  Chemically synthesized
cuggcugcgcuuucucgc

SEQ ID NO: 4426 - RNA, 18 nt, artificial
  Chemically synthesized
ucuucagugugugaaaug

SEQ ID NO: 4427 - RNA, 18 nt, artificial
  Chemically synthesized
uguucaagacugcccagg

SEQ ID NO: 4428 - RNA, 18 nt, artificial
  Chemically synthesized
uucauuaucuuccgcagc

SEQ ID NO: 4429 - RNA, 18 nt, artificial
  Chemically synthesized
acuuuuuggcucauagcu

SEQ ID NO: 4430 - RNA, 18 nt, artificial
  Chemically synthesized
gacagagaagccugauug

SEQ ID NO: 4431 - RNA, 18 nt, artificial
  Chemically synthesized
uaagguucuccacccagu

SEQ ID NO: 4432 - RNA, 18 nt, artificial
  Chemically synthesized
uuucaucggugauuuuca

SEQ ID NO: 4433 - RNA, 18 nt, artificial
  Chemically synthesized
uaacucugucauuaucag

SEQ ID NO: 4434 - RNA, 18 nt, artificial
  Chemically synthesized
uguccaaaucaguaucuc

SEQ ID NO: 4435 - RNA, 18 nt, artificial
  Chemically synthesized
cacuugccaggaaugaag

SEQ ID NO: 4436 - RNA, 18 nt, artificial
  Chemically synthesized
aauuuccagugucuuggg

SEQ ID NO: 4437 - RNA, 18 nt, artificial
  Chemically synthesized
gauccugcuugcaacacc

SEQ ID NO: 4438 - RNA, 18 nt, artificial
  Chemically synthesized
gcuuuuuucucaaugggc

SEQ ID NO: 4439 - RNA, 18 nt, artificial
  Chemically synthesized
auuccauuggaugucagc

SEQ ID NO: 4440 - RNA, 18 nt, artificial
  Chemically synthesized
caaagucuucagugugug

SEQ ID NO: 4441 - RNA, 18 nt, artificial
  Chemically synthesized
gccacuccagguaggucu

SEQ ID NO: 4442 - RNA, 18 nt, artificial
  Chemically synthesized
caaagacaguuuuguggc

SEQ ID NO: 4443 - RNA, 18 nt, artificial
  Chemically synthesized
agagaacgccgagcagcc

SEQ ID NO: 4444 - RNA, 18 nt, artificial
  Chemically synthesized
acagguaccuucacuugg

SEQ ID NO: 4445 - RNA, 18 nt, artificial
  Chemically synthesized
aaugcaucauagcagaug

SEQ ID NO: 4446 - RNA, 18 nt, artificial
  Chemically synthesized
aagcaucaaucucaaguu

SEQ ID NO: 4447 - RNA, 18 nt, artificial
  Chemically synthesized
uucauuugugcuguuucc

SEQ ID NO: 4448 - RNA, 18 nt, artificial
  Chemically synthesized
ucaggauuugcaauuuug

SEQ ID NO: 4449 - RNA, 18 nt, artificial
  Chemically synthesized
aggaagaaagaaugacac

SEQ ID NO: 4450 - RNA, 18 nt, artificial
  Chemically synthesized
aaaaaagagauguuuccc

SEQ ID NO: 4451 - RNA, 18 nt, artificial
  Chemically synthesized
uaugaaggaucagaugac

SEQ ID NO: 4452 - RNA, 18 nt, artificial
  Chemically synthesized
uuaauuccauuggauguc

SEQ ID NO: 4453 - RNA, 18 nt, artificial
  Chemically synthesized
acguuuccacuuuaccug

SEQ ID NO: 4454 - RNA, 18 nt, artificial
  Chemically synthesized
uugagaucagcugcacag

SEQ ID NO: 4455 - RNA, 18 nt, artificial
  Chemically synthesized
uguuuauaaaacagcacc

SEQ ID NO: 4456 - RNA, 18 nt, artificial
  Chemically synthesized
uauaaagugcucagauca

SEQ ID NO: 4457 - RNA, 18 nt, artificial
  Chemically synthesized
uuccuuuuggccuggagc

SEQ ID NO: 4458 - RNA, 18 nt, artificial
  Chemically synthesized
aauaugcugcuucauaug

SEQ ID NO: 4459 - RNA, 18 nt, artificial
  Chemically synthesized
ucuuuucuggccacugac

SEQ ID NO: 4460 - RNA, 18 nt, artificial
  Chemically synthesized
uccauauuucccacucuc

SEQ ID NO: 4461 - RNA, 18 nt, artificial
  Chemically synthesized
uccagaagaaugagaaug

SEQ ID NO: 4462 - RNA, 18 nt, artificial
  Chemically synthesized
agaaagaaugacacaguc

SEQ ID NO: 4463 - RNA, 18 nt, artificial
  Chemically synthesized
cagacaccagugcugucc

SEQ ID NO: 4464 - RNA, 18 nt, artificial
  Chemically synthesized
acguaguuauugcauucc

SEQ ID NO: 4465 - RNA, 18 nt, artificial
  Chemically synthesized
aucaaucucaaguuccuc

SEQ ID NO: 4466 - RNA, 18 nt, artificial
  Chemically synthesized
uccagugcuucaacccac

SEQ ID NO: 4467 - RNA, 18 nt, artificial
  Chemically synthesized
uaagagggaggcaucugg

SEQ ID NO: 4468 - RNA, 18 nt, artificial
  Chemically synthesized
acaacuaccaguugaaag

SEQ ID NO: 4469 - RNA, 18 nt, artificial
  Chemically synthesized
ugucauuaucagaugcuc

SEQ ID NO: 4470 - RNA, 18 nt, artificial
  Chemically synthesized
cuuggaauaugcagccuc

SEQ ID NO: 4471 - RNA, 18 nt, artificial
  Chemically synthesized
uuuucaauggagucaaug

SEQ ID NO: 4472 - RNA, 18 nt, artificial
  Chemically synthesized
aagaucccaacuagacaa

SEQ ID NO: 4473 - RNA, 18 nt, artificial
  Chemically synthesized
aacauuccacggaacuug

SEQ ID NO: 4474 - RNA, 18 nt, artificial
  Chemically synthesized
ucucuccgguuuuuucca

SEQ ID NO: 4475 - RNA, 18 nt, artificial
  Chemically synthesized
uauuucccacucucagga

SEQ ID NO: 4476 - RNA, 18 nt, artificial
  Chemically synthesized
gaccauaagguucuccac

SEQ ID NO: 4477 - RNA, 18 nt, artificial
  Chemically synthesized
gguaggacagagaaugcc

SEQ ID NO: 4478 - RNA, 18 nt, artificial
  Chemically synthesized
cagagaaugccuuuugug

SEQ ID NO: 4479 - RNA, 18 nt, artificial
  Chemically synthesized
ucuuagugaaggugucca

SEQ ID NO: 4480 - RNA, 18 nt, artificial
  Chemically synthesized
uuaaauaugggaaccuag

SEQ ID NO: 4481 - RNA, 18 nt, artificial
  Chemically synthesized
ugaaacaaacuuucaucg

SEQ ID NO: 4482 - RNA, 18 nt, artificial
  Chemically synthesized
ugcuucauaugaaggauc

SEQ ID NO: 4483 - RNA, 18 nt, artificial
  Chemically synthesized
uaccuucacuuggucacu

SEQ ID NO: 4484 - RNA, 18 nt, artificial
  Chemically synthesized
ucaaucucaaguuccuca

SEQ ID NO: 4485 - RNA, 18 nt, artificial
  Chemically synthesized
auuaucuuccgcagcuug

SEQ ID NO: 4486 - RNA, 18 nt, artificial
  Chemically synthesized
uaagcaaguccucaaaug

SEQ ID NO: 4487 - RNA, 18 nt, artificial
  Chemically synthesized
uugcuacagauuacaguu

SEQ ID NO: 4488 - RNA, 18 nt, artificial
  Chemically synthesized
uaacaauccagaaaucug

SEQ ID NO: 4489 - RNA, 18 nt, artificial
  Chemically synthesized
aaugacacagucauugag

SEQ ID NO: 4490 - RNA, 18 nt, artificial
  Chemically synthesized
ucacuauaggucuccuuu

SEQ ID NO: 4491 - RNA, 18 nt, artificial
  Chemically synthesized
guuuuuuccaaugaugcc

SEQ ID NO: 4492 - RNA, 18 nt, artificial
  Chemically synthesized
caccauccacaaaguaug

SEQ ID NO: 4493 - RNA, 18 nt, artificial
  Chemically synthesized
acuccauuaaggguacag

SEQ ID NO: 4494 - RNA, 18 nt, artificial
  Chemically synthesized
uaggcaucccgcucacug

SEQ ID NO: 4495 - RNA, 18 nt, artificial
  Chemically synthesized
uucccuuggauaccaagg

SEQ ID NO: 4496 - RNA, 18 nt, artificial
  Chemically synthesized
uagacaaagacuggucuu

SEQ ID NO: 4497 - RNA, 18 nt, artificial
  Chemically synthesized
gaaacaaaugcaucauag

SEQ ID NO: 4498 - RNA, 18 nt, artificial
  Chemically synthesized
acaagacagagaagccug

SEQ ID NO: 4499 - RNA, 18 nt, artificial
  Chemically synthesized
aaguuauugccaccagcu

SEQ ID NO: 4500 - RNA, 18 nt, artificial
  Chemically synthesized
uuuguagagagggccagg

SEQ ID NO: 4501 - RNA, 18 nt, artificial
  Chemically synthesized
caucuacaaaaaucucca

SEQ ID NO: 4502 - RNA, 18 nt, artificial
  Chemically synthesized
aaucuuccucuauugugu

SEQ ID NO: 4503 - RNA, 18 nt, artificial
  Chemically synthesized
ugagauccaaguauucua

SEQ ID NO: 4504 - RNA, 18 nt, artificial
  Chemically synthesized
acagaggagucucuuagc

SEQ ID NO: 4505 - RNA, 18 nt, artificial
  Chemically synthesized
ucgcaguuccaaacauuc

SEQ ID NO: 4506 - RNA, 18 nt, artificial
  Chemically synthesized
ucuuaaauaugggaaccu

SEQ ID NO: 4507 - RNA, 18 nt, artificial
  Chemically synthesized
acagcacuuuuuucuagg

SEQ ID NO: 4508 - RNA, 18 nt, artificial
  Chemically synthesized
ggauaagucuaaauguuc

SEQ ID NO: 4509 - RNA, 18 nt, artificial
  Chemically synthesized
ucaaaaagacggaaaugg

SEQ ID NO: 4510 - RNA, 18 nt, artificial
  Chemically synthesized
gggaauggcuuuuuucuc

SEQ ID NO: 4511 - RNA, 18 nt, artificial
  Chemically synthesized
caaagacuggucuuaaau

SEQ ID NO: 4512 - RNA, 18 nt, artificial
  Chemically synthesized
gucuuaaauaugggaacc

SEQ ID NO: 4513 - RNA, 18 nt, artificial
  Chemically synthesized
aguuggcccucuauaucc

SEQ ID NO: 4514 - RNA, 18 nt, artificial
  Chemically synthesized
gaagaaagaaugacacag

SEQ ID NO: 4515 - RNA, 18 nt, artificial
  Chemically synthesized
gcagcucucagauuuacc

SEQ ID NO: 4516 - RNA, 18 nt, artificial
  Chemically synthesized
uagacuuaugaucauggu

SEQ ID NO: 4517 - RNA, 18 nt, artificial
  Chemically synthesized
cugugacauuccgacacc

SEQ ID NO: 4518 - RNA, 18 nt, artificial
  Chemically synthesized
guucuccacccaguaggc

SEQ ID NO: 4519 - RNA, 18 nt, artificial
  Chemically synthesized
aaggaagguaaguccagc

SEQ ID NO: 4520 - RNA, 18 nt, artificial
  Chemically synthesized
aacuuuuuggcucauagc

SEQ ID NO: 4521 - RNA, 18 nt, artificial
  Chemically synthesized
ucauagcucuguagaucu

SEQ ID NO: 4522 - RNA, 18 nt, artificial
  Chemically synthesized
agagugagcaaagucucu

SEQ ID NO: 4523 - RNA, 18 nt, artificial
  Chemically synthesized
auacuaguaacaugggua

SEQ ID NO: 4524 - RNA, 18 nt, artificial
  Chemically synthesized
uuguuguugcuaacaucu

SEQ ID NO: 4525 - RNA, 18 nt, artificial
  Chemically synthesized
gagucaucaacuuauuuc

SEQ ID NO: 4526 - RNA, 18 nt, artificial
  Chemically synthesized
cucauagcucuguagauc

SEQ ID NO: 4527 - RNA, 18 nt, artificial
  Chemically synthesized
aaagaaugacacagucau

SEQ ID NO: 4528 - RNA, 18 nt, artificial
  Chemically synthesized
ugcucuaaaauuaccaac

SEQ ID NO: 4529 - RNA, 18 nt, artificial
  Chemically synthesized
gauccaaguauucuaaug

SEQ ID NO: 4530 - RNA, 18 nt, artificial
  Chemically synthesized
uuuccugggcuuccuuuu

SEQ ID NO: 4531 - RNA, 18 nt, artificial
  Chemically synthesized
ucccgcuuaugaagacac

SEQ ID NO: 4532 - RNA, 18 nt, artificial
  Chemically synthesized
augucagcaccagagccu

SEQ ID NO: 4533 - RNA, 18 nt, artificial
  Chemically synthesized
cauauuucccacucucag

SEQ ID NO: 4534 - RNA, 18 nt, artificial
  Chemically synthesized
gauaguucugaaaaaugg

SEQ ID NO: 4535 - RNA, 18 nt, artificial
  Chemically synthesized
aaaguauguggcauuguc

SEQ ID NO: 4536 - RNA, 18 nt, artificial
  Chemically synthesized
ucacaggcugaauuuuuc

SEQ ID NO: 4537 - RNA, 18 nt, artificial
  Chemically synthesized
agcaguaaaauaugcugc

SEQ ID NO: 4538 - RNA, 18 nt, artificial
  Chemically synthesized
ucaaucaagacuuuggcc

SEQ ID NO: 4539 - RNA, 18 nt, artificial
  Chemically synthesized
uaugcagccuccggauug

SEQ ID NO: 4540 - RNA, 18 nt, artificial
  Chemically synthesized
gguacagucaucaaacuc

SEQ ID NO: 4541 - RNA, 18 nt, artificial
  Chemically synthesized
gacagagaaugccuuuug

SEQ ID NO: 4542 - RNA, 18 nt, artificial
  Chemically synthesized
ucaccugagagaacgccg

SEQ ID NO: 4543 - RNA, 18 nt, artificial
  Chemically synthesized
aguuuuguggcucuuuuc

SEQ ID NO: 4544 - RNA, 18 nt, artificial
  Chemically synthesized
guaggacagagaaugccu

SEQ ID NO: 4545 - RNA, 18 nt, artificial
  Chemically synthesized
gucacacagguaauuugc

SEQ ID NO: 4546 - RNA, 18 nt, artificial
  Chemically synthesized
aaguucuuugaguugcgg

SEQ ID NO: 4547 - RNA, 18 nt, artificial
  Chemically synthesized
guuauugccaccagcuuc

SEQ ID NO: 4548 - RNA, 18 nt, artificial
  Chemically synthesized
aguuccaaacauuccacg

SEQ ID NO: 4549 - RNA, 18 nt, artificial
  Chemically synthesized
gagaggcugaugaugacc

SEQ ID NO: 4550 - RNA, 18 nt, artificial
  Chemically synthesized
uggcugcgcuuucucgcu

SEQ ID NO: 4551 - RNA, 18 nt, artificial
  Chemically synthesized
aagggacuauauucagau

SEQ ID NO: 4552 - RNA, 18 nt, artificial
  Chemically synthesized
aguauucuucaaccauca

SEQ ID NO: 4553 - RNA, 18 nt, artificial
  Chemically synthesized
guugcuacagauuacagu

SEQ ID NO: 4554 - RNA, 18 nt, artificial
  Chemically synthesized
auuuugauauccacgagg

SEQ ID NO: 4555 - RNA, 18 nt, artificial
  Chemically synthesized
gaagugacagcuagguag

SEQ ID NO: 4556 - RNA, 18 nt, artificial
  Chemically synthesized
aguaaacaaggaaccaga

SEQ ID NO: 4557 - RNA, 18 nt, artificial
  Chemically synthesized
aaguucuccagcuccugg

SEQ ID NO: 4558 - RNA, 18 nt, artificial
  Chemically synthesized
aaugacgguacauccacg

SEQ ID NO: 4559 - RNA, 18 nt, artificial
  Chemically synthesized
auuguuaacguuuccacu

SEQ ID NO: 4560 - RNA, 18 nt, artificial
  Chemically synthesized
aagucucuccgguuuuuu

SEQ ID NO: 4561 - RNA, 18 nt, artificial
  Chemically synthesized
agugcuucaacccacaac

SEQ ID NO: 4562 - RNA, 18 nt, artificial
  Chemically synthesized
ccaagacccacaccaucc

SEQ ID NO: 4563 - RNA, 18 nt, artificial
  Chemically synthesized
auggagucaaugauauug

SEQ ID NO: 4564 - RNA, 18 nt, artificial
  Chemically synthesized
gaaccuaggacuuuaucg

SEQ ID NO: 4565 - RNA, 18 nt, artificial
  Chemically synthesized
ugggagucacuauagguc

SEQ ID NO: 4566 - RNA, 18 nt, artificial
  Chemically synthesized
ggauugaaguucuccagc

SEQ ID NO: 4567 - RNA, 18 nt, artificial
  Chemically synthesized
aaauacuuugccuuguug

SEQ ID NO: 4568 - RNA, 18 nt, artificial
  Chemically synthesized
augccagacaccagugcu

SEQ ID NO: 4569 - RNA, 18 nt, artificial
  Chemically synthesized
aguaaaauaugcugcuuc

SEQ ID NO: 4570 - RNA, 18 nt, artificial
  Chemically synthesized
guugcggcaaauucaaag

SEQ ID NO: 4571 - RNA, 18 nt, artificial
  Chemically synthesized
agugaaggagaggaauuc

SEQ ID NO: 4572 - RNA, 18 nt, artificial
  Chemically synthesized
uuaaaguuuguagagagg

SEQ ID NO: 4573 - RNA, 18 nt, artificial
  Chemically synthesized
aacuaagccaguugcuac

SEQ ID NO: 4574 - RNA, 18 nt, artificial
  Chemically synthesized
aaaagacggaaaugggag

SEQ ID NO: 4575 - RNA, 18 nt, artificial
  Chemically synthesized
agcaucauuguucucauc

SEQ ID NO: 4576 - RNA, 18 nt, artificial
  Chemically synthesized
cugggagaacuccgagca

SEQ ID NO: 4577 - RNA, 18 nt, artificial
  Chemically synthesized
aucccaacuagacaaaga

SEQ ID NO: 4578 - RNA, 18 nt, artificial
  Chemically synthesized
gucuugguguucauuauc

SEQ ID NO: 4579 - RNA, 18 nt, artificial
  Chemically synthesized
aucauagcagauguuccu

SEQ ID NO: 4580 - RNA, 18 nt, artificial
  Chemically synthesized
aguuuuucagagugagca

SEQ ID NO: 4581 - RNA, 18 nt, artificial
  Chemically synthesized
uuguuggacaggucaagg

SEQ ID NO: 4582 - RNA, 18 nt, artificial
  Chemically synthesized
aaguuucaggcauagaau

SEQ ID NO: 4583 - RNA, 18 nt, artificial
  Chemically synthesized
uaggacagagaaugccuu

SEQ ID NO: 4584 - RNA, 18 nt, artificial
  Chemically synthesized
uuuccagugucuugggaa

SEQ ID NO: 4585 - RNA, 18 nt, artificial
  Chemically synthesized
aaguccaguucauacuug

SEQ ID NO: 4586 - RNA, 18 nt, artificial
  Chemically synthesized
aauuuucacugagaucca

SEQ ID NO: 4587 - RNA, 18 nt, artificial
  Chemically synthesized
uaaggauuucccaguaag

SEQ ID NO: 4588 - RNA, 18 nt, artificial
  Chemically synthesized
uugcuccuuagaaaacgu

SEQ ID NO: 4589 - RNA, 18 nt, artificial
  Chemically synthesized
aagaaagaaugacacagu

SEQ ID NO: 4590 - RNA, 18 nt, artificial
  Chemically synthesized
augggcuccagaagaaug

SEQ ID NO: 4591 - RNA, 18 nt, artificial
  Chemically synthesized
gcagcaucauuguucuca

SEQ ID NO: 4592 - RNA, 18 nt, artificial
  Chemically synthesized
cuccuuagaaaacguagu

SEQ ID NO: 4593 - RNA, 18 nt, artificial
  Chemically synthesized
ugcugcuucauaugaagg

SEQ ID NO: 4594 - RNA, 18 nt, artificial
  Chemically synthesized
uggccacugacaaguuuc

SEQ ID NO: 4595 - RNA, 18 nt, artificial
  Chemically synthesized
gaacuuguaacaucuaca

SEQ ID NO: 4596 - RNA, 18 nt, artificial
  Chemically synthesized
gguucugcauccaugaag

SEQ ID NO: 4597 - RNA, 18 nt, artificial
  Chemically synthesized
uucacacaccucuguagg

SEQ ID NO: 4598 - RNA, 18 nt, artificial
  Chemically synthesized
agcuuccaaagucuucag

SEQ ID NO: 4599 - RNA, 18 nt, artificial
  Chemically synthesized
ugaucaugguuaucucau

SEQ ID NO: 4600 - RNA, 18 nt, artificial
  Chemically synthesized
ucagauuuacccaaaauc

SEQ ID NO: 4601 - RNA, 18 nt, artificial
  Chemically synthesized
uaccauugcggucacaag

SEQ ID NO: 4602 - RNA, 18 nt, artificial
  Chemically synthesized
guucugcauccaugaagu

SEQ ID NO: 4603 - RNA, 18 nt, artificial
  Chemically synthesized
aucaguaucucgcaguuc

SEQ ID NO: 4604 - RNA, 18 nt, artificial
  Chemically synthesized
guucauacuugcaccacu

SEQ ID NO: 4605 - RNA, 18 nt, artificial
  Chemically synthesized
cuguaagaaacaaaugca

SEQ ID NO: 4606 - RNA, 18 nt, artificial
  Chemically synthesized
uggagucaaugauauugu

SEQ ID NO: 4607 - RNA, 18 nt, artificial
  Chemically synthesized
cucuguagaucugaagca

SEQ ID NO: 4608 - RNA, 18 nt, artificial
  Chemically synthesized
uuacacuguguauucgug

SEQ ID NO: 4609 - RNA, 18 nt, artificial
  Chemically synthesized
ugccaaaugauuuugccu

SEQ ID NO: 4610 - RNA, 18 nt, artificial
  Chemically synthesized
uguuacacuguguauucg

SEQ ID NO: 4611 - RNA, 18 nt, artificial
  Chemically synthesized
cuuuuuucuaggaauagc

SEQ ID NO: 4612 - RNA, 18 nt, artificial
  Chemically synthesized
ugggauggagagucacac

SEQ ID NO: 4613 - RNA, 18 nt, artificial
  Chemically synthesized
aacaccaaacacugggag

SEQ ID NO: 4614 - RNA, 18 nt, artificial
  Chemically synthesized
gaugucagcaccagagcc

SEQ ID NO: 4615 - RNA, 18 nt, artificial
  Chemically synthesized
aaggaucagaugacuuac

SEQ ID NO: 4616 - RNA, 18 nt, artificial
  Chemically synthesized
uuaucuuccgcagcuugc

SEQ ID NO: 4617 - RNA, 18 nt, artificial
  Chemically synthesized
auaggaaauacacagcac

SEQ ID NO: 4618 - RNA, 18 nt, artificial
  Chemically synthesized
cugaaacaaacuuucauc

SEQ ID NO: 4619 - RNA, 18 nt, artificial
  Chemically synthesized
aguuucaggcauagaaug

SEQ ID NO: 4620 - RNA, 18 nt, artificial
  Chemically synthesized
aagucuucagugugugaa

SEQ ID NO: 4621 - RNA, 18 nt, artificial
  Chemically synthesized
aacgguggcacaggaccc

SEQ ID NO: 4622 - RNA, 18 nt, artificial
  Chemically synthesized
cucuguaggucacuguug

SEQ ID NO: 4623 - RNA, 18 nt, artificial
  Chemically synthesized
uuagcaggaagaaagaau

SEQ ID NO: 4624 - RNA, 18 nt, artificial
  Chemically synthesized
aauucacaggagcaaaug

SEQ ID NO: 4625 - RNA, 18 nt, artificial
  Chemically synthesized
uacagucaucaaacucua

SEQ ID NO: 4626 - RNA, 18 nt, artificial
  Chemically synthesized
uucaacccacaacuacca

SEQ ID NO: 4627 - RNA, 18 nt, artificial
  Chemically synthesized
aacuagacaaagacuggu

SEQ ID NO: 4628 - RNA, 18 nt, artificial
  Chemically synthesized
augagucaaguugcuccu

SEQ ID NO: 4629 - RNA, 18 nt, artificial
  Chemically synthesized
aaguuuuucagagugagc

SEQ ID NO: 4630 - RNA, 18 nt, artificial
  Chemically synthesized
cacuguguauucgugugc

SEQ ID NO: 4631 - RNA, 18 nt, artificial
  Chemically synthesized
ucuccgguuuuuuccaau

SEQ ID NO: 4632 - RNA, 18 nt, artificial
  Chemically synthesized
auuaccaacuccauuaag

SEQ ID NO: 4633 - RNA, 18 nt, artificial
  Chemically synthesized
ucaaguuccucaaggaag

SEQ ID NO: 4634 - RNA, 18 nt, artificial
  Chemically synthesized
auaaagaucccaacuaga

SEQ ID NO: 4635 - RNA, 18 nt, artificial
  Chemically synthesized
auuuacccaaaauccuuc

SEQ ID NO: 4636 - RNA, 18 nt, artificial
  Chemically synthesized
caggaaugaagucccgcu

SEQ ID NO: 4637 - RNA, 18 nt, artificial
  Chemically synthesized
ugacauuccgacaccgag

SEQ ID NO: 4638 - RNA, 18 nt, artificial
  Chemically synthesized
aagaaucuuccucuauug

SEQ ID NO: 4639 - RNA, 18 nt, artificial
  Chemically synthesized
cugcaaccaauucccuug

SEQ ID NO: 4640 - RNA, 18 nt, artificial
  Chemically synthesized
cagagcacagcacaugcc

SEQ ID NO: 4641 - RNA, 18 nt, artificial
  Chemically synthesized
agacccacaccauccaca

SEQ ID NO: 4642 - RNA, 18 nt, artificial
  Chemically synthesized
cuucugugagcccugagg

SEQ ID NO: 4643 - RNA, 18 nt, artificial
  Chemically synthesized
gaggcaucugguagaguc

SEQ ID NO: 4644 - RNA, 18 nt, artificial
  Chemically synthesized
cacugggagaacuccgag

SEQ ID NO: 4645 - RNA, 18 nt, artificial
  Chemically synthesized
agaugacuuacauucuga

SEQ ID NO: 4646 - RNA, 18 nt, artificial
  Chemically synthesized
gcaucauuguucucauca

SEQ ID NO: 4647 - RNA, 18 nt, artificial
  Chemically synthesized
ccacucucaggauuugca

SEQ ID NO: 4648 - RNA, 18 nt, artificial
  Chemically synthesized
gcuuaugaagacacaacu

SEQ ID NO: 4649 - RNA, 18 nt, artificial
  Chemically synthesized
guugcuccuuagaaaacg

SEQ ID NO: 4650 - RNA, 18 nt, artificial
  Chemically synthesized
gguuuuuuccaaugaugc

SEQ ID NO: 4651 - RNA, 18 nt, artificial
  Chemically synthesized
uguguauucgugugcugg

SEQ ID NO: 4652 - RNA, 18 nt, artificial
  Chemically synthesized
ucaugguuaucucauaga

SEQ ID NO: 4653 - RNA, 18 nt, artificial
  Chemically synthesized
cauucugaauugacuuca

SEQ ID NO: 4654 - RNA, 18 nt, artificial
  Chemically synthesized
agaaaaagaaucuuccuc

SEQ ID NO: 4655 - RNA, 18 nt, artificial
  Chemically synthesized
ucagaugacuuacauucu

SEQ ID NO: 4656 - RNA, 18 nt, artificial
  Chemically synthesized
agagcaaugggcacaaug

SEQ ID NO: 4657 - RNA, 18 nt, artificial
  Chemically synthesized
aggcauagaaugaaaacu

SEQ ID NO: 4658 - RNA, 18 nt, artificial
  Chemically synthesized
aguguccaaaucaguauc

SEQ ID NO: 4659 - RNA, 18 nt, artificial
  Chemically synthesized
auuuucauauaccacagg

SEQ ID NO: 4660 - RNA, 18 nt, artificial
  Chemically synthesized
ggaucagcaggaacagag

SEQ ID NO: 4661 - RNA, 18 nt, artificial
  Chemically synthesized
uggcagcaucauuguucu

SEQ ID NO: 4662 - RNA, 18 nt, artificial
  Chemically synthesized
agcccugagggaauggag

SEQ ID NO: 4663 - RNA, 18 nt, artificial
  Chemically synthesized
agucacacagguaauuug

SEQ ID NO: 4664 - RNA, 18 nt, artificial
  Chemically synthesized
uuaaggguacagucauca

SEQ ID NO: 4665 - RNA, 18 nt, artificial
  Chemically synthesized
acucuucacaaaguuuuc

SEQ ID NO: 4666 - RNA, 18 nt, artificial
  Chemically synthesized
auucccuuggauaccaag

SEQ ID NO: 4667 - RNA, 18 nt, artificial
  Chemically synthesized
agaagaaugagaauggca

SEQ ID NO: 4668 - RNA, 18 nt, artificial
  Chemically synthesized
ugaagacacaacuugaag

SEQ ID NO: 4669 - RNA, 18 nt, artificial
  Chemically synthesized
auccugcuugcaacacca

SEQ ID NO: 4670 - RNA, 18 nt, artificial
  Chemically synthesized
ugggcuuccuuuuggccu

SEQ ID NO: 4671 - RNA, 18 nt, artificial
  Chemically synthesized
guuccaaacauuccacgg

SEQ ID NO: 4672 - RNA, 18 nt, artificial
  Chemically synthesized
uauccauggguucugcau

SEQ ID NO: 4673 - RNA, 18 nt, artificial
  Chemically synthesized
gaucccaacuagacaaag

SEQ ID NO: 4674 - RNA, 18 nt, artificial
  Chemically synthesized
auacacagcacuuuuuuc

SEQ ID NO: 4675 - RNA, 18 nt, artificial
  Chemically synthesized
uguccauauuucccacuc

SEQ ID NO: 4676 - RNA, 18 nt, artificial
  Chemically synthesized
cauccaugaagucaacca

SEQ ID NO: 4677 - RNA, 18 nt, artificial
  Chemically synthesized
agcagugaaagagcaaug

SEQ ID NO: 4678 - RNA, 18 nt, artificial
  Chemically synthesized
gucaccugagagaacgcc

SEQ ID NO: 4679 - RNA, 18 nt, artificial
  Chemically synthesized
gauuguuaacguuuccac

SEQ ID NO: 4680 - RNA, 18 nt, artificial
  Chemically synthesized
aaugaagucccgcuuaug

SEQ ID NO: 4681 - RNA, 18 nt, artificial
  Chemically synthesized
auccuucccgcugagccu

SEQ ID NO: 4682 - RNA, 18 nt, artificial
  Chemically synthesized
acucucaggauuugcaau

SEQ ID NO: 4683 - RNA, 18 nt, artificial
  Chemically synthesized
agauuuacccaaaauccu

SEQ ID NO: 4684 - RNA, 18 nt, artificial
  Chemically synthesized
uuccaaagucuucagugu

SEQ ID NO: 4685 - RNA, 18 nt, artificial
  Chemically synthesized
uucuuccuuggagaggcu

SEQ ID NO: 4686 - RNA, 18 nt, artificial
  Chemically synthesized
uugcucuugagaucagcu

SEQ ID NO: 4687 - RNA, 18 nt, artificial
  Chemically synthesized
agucaaguugcuccuuag

SEQ ID NO: 4688 - RNA, 18 nt, artificial
  Chemically synthesized
cugugauucuuuuaacuc

SEQ ID NO: 4689 - RNA, 18 nt, artificial
  Chemically synthesized
auuggaugucagcaccag

SEQ ID NO: 4690 - RNA, 18 nt, artificial
  Chemically synthesized
uuggagaggcugaugaug

SEQ ID NO: 4691 - RNA, 18 nt, artificial
  Chemically synthesized
agguguccauauuuccca

SEQ ID NO: 4692 - RNA, 18 nt, artificial
  Chemically synthesized
uccaugaagucaaccaac

SEQ ID NO: 4693 - RNA, 18 nt, artificial
  Chemically synthesized
agaacgccgagcagccgc

SEQ ID NO: 4694 - RNA, 18 nt, artificial
  Chemically synthesized
uaauguaggugauccugu

SEQ ID NO: 4695 - RNA, 18 nt, artificial
  Chemically synthesized
gcucuguagaucugaagc

SEQ ID NO: 4696 - RNA, 18 nt, artificial
  Chemically synthesized
gucaaccaacuguggauc

SEQ ID NO: 4697 - RNA, 18 nt, artificial
  Chemically synthesized
guaacauggguaagaggg

SEQ ID NO: 4698 - RNA, 18 nt, artificial
  Chemically synthesized
gaagaaugagaauggcag

SEQ ID NO: 4699 - RNA, 18 nt, artificial
  Chemically synthesized
guacauccacguaguuuu

SEQ ID NO: 4700 - RNA, 18 nt, artificial
  Chemically synthesized
uagaucugaagcaucaau

SEQ ID NO: 4701 - RNA, 18 nt, artificial
  Chemically synthesized
cacagagaagugacagcu

SEQ ID NO: 4702 - RNA, 18 nt, artificial
  Chemically synthesized
uugccaccagcuuccaaa

SEQ ID NO: 4703 - RNA, 18 nt, artificial
  Chemically synthesized
ugcccuugcagauaccau

SEQ ID NO: 4704 - RNA, 18 nt, artificial
  Chemically synthesized
gucacuauaggucuccuu

SEQ ID NO: 4705 - RNA, 18 nt, artificial
  Chemically synthesized
aagugacagcuagguagg

SEQ ID NO: 4706 - RNA, 18 nt, artificial
  Chemically synthesized
gagaagccugauuggagg

SEQ ID NO: 4707 - RNA, 18 nt, artificial
  Chemically synthesized
uuccacggaacuuguaac

SEQ ID NO: 4708 - RNA, 18 nt, artificial
  Chemically synthesized
gagucucuuagcaggaag

SEQ ID NO: 4709 - RNA, 18 nt, artificial
  Chemically synthesized
augacgguacauccacgu

SEQ ID NO: 4710 - RNA, 18 nt, artificial
  Chemically synthesized
cagcaucauuguucucau

SEQ ID NO: 4711 - RNA, 18 nt, artificial
  Chemically synthesized
uugcaccacucacucuuc

SEQ ID NO: 4712 - RNA, 18 nt, artificial
  Chemically synthesized
uugcauuccuacugauuu

SEQ ID NO: 4713 - RNA, 18 nt, artificial
  Chemically synthesized
agagaagugacagcuagg

SEQ ID NO: 4714 - RNA, 18 nt, artificial
  Chemically synthesized
gagaaguccaguucauac

SEQ ID NO: 4715 - RNA, 18 nt, artificial
  Chemically synthesized
cgcuuucucgcugccucc

SEQ ID NO: 4716 - RNA, 18 nt, artificial
  Chemically synthesized
gaacgccgagcagccgcc

SEQ ID NO: 4717 - RNA, 18 nt, artificial
  Chemically synthesized
uuccgacaccgagaggcg

SEQ ID NO: 4718 - RNA, 18 nt, artificial
  Chemically synthesized
aaagcacaaagacaguuu

SEQ ID NO: 4719 - RNA, 18 nt, artificial
  Chemically synthesized
cacucacucuucacaaag

SEQ ID NO: 4720 - RNA, 18 nt, artificial
  Chemically synthesized
accucuguaggucacugu

SEQ ID NO: 4721 - RNA, 18 nt, artificial
  Chemically synthesized
ccgcucacuguaagaaac

SEQ ID NO: 4722 - RNA, 18 nt, artificial
  Chemically synthesized
gaugcucuaaaauuacca

SEQ ID NO: 4723 - RNA, 18 nt, artificial
  Chemically synthesized
gaaaaaagagauguuucc

SEQ ID NO: 4724 - RNA, 18 nt, artificial
  Chemically synthesized
gaggauucuuccuuggag

SEQ ID NO: 4725 - RNA, 18 nt, artificial
  Chemically synthesized
uccagguaggucuuggug

SEQ ID NO: 4726 - RNA, 18 nt, artificial
  Chemically synthesized
augaagucaaccaacugu

SEQ ID NO: 4727 - RNA, 18 nt, artificial
  Chemically synthesized
gaggagucucuuagcagg

SEQ ID NO: 4728 - RNA, 18 nt, artificial
  Chemically synthesized
gugaauauaaagugcuca

SEQ ID NO: 4729 - RNA, 18 nt, artificial
  Chemically synthesized
ggucuccuuuggauccug

SEQ ID NO: 4730 - RNA, 18 nt, artificial
  Chemically synthesized
ugugugaaaugagucaag

SEQ ID NO: 4731 - RNA, 18 nt, artificial
  Chemically synthesized
uggccacagaggagucuc

SEQ ID NO: 4732 - RNA, 18 nt, artificial
  Chemically synthesized
cucacuguaagaaacaaa

SEQ ID NO: 4733 - RNA, 18 nt, artificial
  Chemically synthesized
aaugggcacaaugagccc

SEQ ID NO: 4734 - RNA, 18 nt, artificial
  Chemically synthesized
caccagcuuccaaagucu

SEQ ID NO: 4735 - RNA, 18 nt, artificial
  Chemically synthesized
ugacagcuagguaggaca

SEQ ID NO: 4736 - RNA, 18 nt, artificial
  Chemically synthesized
acugagauccaaguauuc

SEQ ID NO: 4737 - RNA, 18 nt, artificial
  Chemically synthesized
cacaugggauggagaguc

SEQ ID NO: 4738 - RNA, 18 nt, artificial
  Chemically synthesized
acauuccgacaccgagag

SEQ ID NO: 4739 - RNA, 18 nt, artificial
  Chemically synthesized
uugcuaauguaggugauc

SEQ ID NO: 4740 - RNA, 18 nt, artificial
  Chemically synthesized
uuucaucuuuucuggcca

SEQ ID NO: 4741 - RNA, 18 nt, artificial
  Chemically synthesized
ucuguagaucugaagcau

SEQ ID NO: 4742 - RNA, 18 nt, artificial
  Chemically synthesized
ucagcugcacagagaagu

SEQ ID NO: 4743 - RNA, 18 nt, artificial
  Chemically synthesized
agugucuugggaaugcag

SEQ ID NO: 4744 - RNA, 18 nt, artificial
  Chemically synthesized
uuccauuggaugucagca

SEQ ID NO: 4745 - RNA, 18 nt, artificial
  Chemically synthesized
uuuguuucaccaguggau

SEQ ID NO: 4746 - RNA, 18 nt, artificial
  Chemically synthesized
uguagaucugaagcauca

SEQ ID NO: 4747 - RNA, 18 nt, artificial
  Chemically synthesized
aggcugaauuuuucaagu

SEQ ID NO: 4748 - RNA, 18 nt, artificial
  Chemically synthesized
caguuccaaacauuccac

SEQ ID NO: 4749 - RNA, 18 nt, artificial
  Chemically synthesized
acagcacaugccagacac

SEQ ID NO: 4750 - RNA, 18 nt, artificial
  Chemically synthesized
cagucaucaaacucuaau

SEQ ID NO: 4751 - RNA, 18 nt, artificial
  Chemically synthesized
guguucauuaucuuccgc

SEQ ID NO: 4752 - RNA, 18 nt, artificial
  Chemically synthesized
ugaagguguccauauuuc

SEQ ID NO: 4753 - RNA, 18 nt, artificial
  Chemically synthesized
gcuccuggaccauaaggu

SEQ ID NO: 4754 - RNA, 18 nt, artificial
  Chemically synthesized
cagggaagaaaaagaauc

SEQ ID NO: 4755 - RNA, 18 nt, artificial
  Chemically synthesized
cugggcuuccuuuuggcc

SEQ ID NO: 4756 - RNA, 18 nt, artificial
  Chemically synthesized
acggaacuuguaacaucu

SEQ ID NO: 4757 - RNA, 18 nt, artificial
  Chemically synthesized
uugucaaugauccacuug

SEQ ID NO: 4758 - RNA, 18 nt, artificial
  Chemically synthesized
gaaucuuccucuauugug

SEQ ID NO: 4759 - RNA, 18 nt, artificial
  Chemically synthesized
ucuauauccauggguucu

SEQ ID NO: 4760 - RNA, 18 nt, artificial
  Chemically synthesized
cucugucauuaucagaug

SEQ ID NO: 4761 - RNA, 18 nt, artificial
  Chemically synthesized
uuuuuacagcuucuguga

SEQ ID NO: 4762 - RNA, 18 nt, artificial
  Chemically synthesized
aaggcuuuuuacagcuuc

SEQ ID NO: 4763 - RNA, 18 nt, artificial
  Chemically synthesized
cuccagguaggucuuggu

SEQ ID NO: 4764 - RNA, 18 nt, artificial
  Chemically synthesized
caggaagaaagaaugaca

SEQ ID NO: 4765 - RNA, 18 nt, artificial
  Chemically synthesized
caucuaaaauuuccagug

SEQ ID NO: 4766 - RNA, 18 nt, artificial
  Chemically synthesized
aguucuccagcuccugga

SEQ ID NO: 4767 - RNA, 18 nt, artificial
  Chemically synthesized
acucuuucuguaagugaa

SEQ ID NO: 4768 - RNA, 18 nt, artificial
  Chemically synthesized
ggauuugcaauuuuguga

SEQ ID NO: 4769 - RNA, 18 nt, artificial
  Chemically synthesized
auuaaggguacagucauc

SEQ ID NO: 4770 - RNA, 18 nt, artificial
  Chemically synthesized
ucuuccgcagcuugcaga

SEQ ID NO: 4771 - RNA, 18 nt, artificial
  Chemically synthesized
aguugcuacagauuacag

SEQ ID NO: 4772 - RNA, 18 nt, artificial
  Chemically synthesized
augacacagucauugaga

SEQ ID NO: 4773 - RNA, 18 nt, artificial
  Chemically synthesized
uaguaacauggguaagag

SEQ ID NO: 4774 - RNA, 18 nt, artificial
  Chemically synthesized
ggaauggcuuuuuucuca

SEQ ID NO: 4775 - RNA, 18 nt, artificial
  Chemically synthesized
cauaaagaucccaacuag

SEQ ID NO: 4776 - RNA, 18 nt, artificial
  Chemically synthesized
guagagucaucaacuuau

SEQ ID NO: 4777 - RNA, 18 nt, artificial
  Chemically synthesized
cugagauccaaguauucu

SEQ ID NO: 4778 - RNA, 18 nt, artificial
  Chemically synthesized
aagucaaccaacugugga

SEQ ID NO: 4779 - RNA, 18 nt, artificial
  Chemically synthesized
gacuuaugaucaugguua

SEQ ID NO: 4780 - RNA, 18 nt, artificial
  Chemically synthesized
cuccauuaaggguacagu

SEQ ID NO: 4781 - RNA, 18 nt, artificial
  Chemically synthesized
cgcuuaugaagacacaac

SEQ ID NO: 4782 - RNA, 18 nt, artificial
  Chemically synthesized
ucagcaggaacagagcac

SEQ ID NO: 4783 - RNA, 18 nt, artificial
  Chemically synthesized
cauccugaaccugcuggc

SEQ ID NO: 4784 - RNA, 18 nt, artificial
  Chemically synthesized
cuguugcuaauguaggug

SEQ ID NO: 4785 - RNA, 18 nt, artificial
  Chemically synthesized
uuuaucgcagcucucaga

SEQ ID NO: 4786 - RNA, 18 nt, artificial
  Chemically synthesized
auccugagcugcccuugc

SEQ ID NO: 4787 - RNA, 18 nt, artificial
  Chemically synthesized
ugcacagagaagugacag

SEQ ID NO: 4788 - RNA, 18 nt, artificial
  Chemically synthesized
ugaugccaaaugauuuug

SEQ ID NO: 4789 - RNA, 18 nt, artificial
  Chemically synthesized
cagugaaagagcaauggg

SEQ ID NO: 4790 - RNA, 18 nt, artificial
  Chemically synthesized
uucauaugaaggaucaga

SEQ ID NO: 4791 - RNA, 18 nt, artificial
  Chemically synthesized
agacaguuuuguggcucu

SEQ ID NO: 4792 - RNA, 18 nt, artificial
  Chemically synthesized
aguucauacuugcaccac

SEQ ID NO: 4793 - RNA, 18 nt, artificial
  Chemically synthesized
ucuaaaauuuccaguguc

SEQ ID NO: 4794 - RNA, 18 nt, artificial
  Chemically synthesized
guucuuugaguugcggca

SEQ ID NO: 4795 - RNA, 18 nt, artificial
  Chemically synthesized
guuuguagagagggccag

SEQ ID NO: 4796 - RNA, 18 nt, artificial
  Chemically synthesized
cucuauauccauggguuc

SEQ ID NO: 4797 - RNA, 18 nt, artificial
  Chemically synthesized
accgagaggcggacaucc

SEQ ID NO: 4798 - RNA, 18 nt, artificial
  Chemically synthesized
caucaaauuuucacugag

SEQ ID NO: 4799 - RNA, 18 nt, artificial
  Chemically synthesized
cacaaagacaguuuugug

SEQ ID NO: 4800 - RNA, 18 nt, artificial
  Chemically synthesized
auuguccagugcuucaac

SEQ ID NO: 4801 - RNA, 18 nt, artificial
  Chemically synthesized
aacguaguuauugcauuc

SEQ ID NO: 4802 - RNA, 18 nt, artificial
  Chemically synthesized
uccuggaccauaagguuc

SEQ ID NO: 4803 - RNA, 18 nt, artificial
  Chemically synthesized
caaucaaucaagacuuug

SEQ ID NO: 4804 - RNA, 18 nt, artificial
  Chemically synthesized
acagagcacagcacaugc

SEQ ID NO: 4805 - RNA, 18 nt, artificial
  Chemically synthesized
aaaguaaacaaggaacca

SEQ ID NO: 4806 - RNA, 18 nt, artificial
  Chemically synthesized
acuccgagcagucaccug

SEQ ID NO: 4807 - RNA, 18 nt, artificial
  Chemically synthesized
agcaucaaucucaaguuc

SEQ ID NO: 4808 - RNA, 18 nt, artificial
  Chemically synthesized
auagcagauguuccugcu

SEQ ID NO: 4809 - RNA, 18 nt, artificial
  Chemically synthesized
augcaucauagcagaugu

SEQ ID NO: 4810 - RNA, 18 nt, artificial
  Chemically synthesized
agucaaccaacuguggau

SEQ ID NO: 4811 - RNA, 18 nt, artificial
  Chemically synthesized
aaugggagaaguccaguu

SEQ ID NO: 4812 - RNA, 18 nt, artificial
  Chemically synthesized
accaguggauaguucuga

SEQ ID NO: 4813 - RNA, 18 nt, artificial
  Chemically synthesized
uuuuguggcucuuuucaa

SEQ ID NO: 4814 - RNA, 18 nt, artificial
  Chemically synthesized
gucuaaauguucaagacu

SEQ ID NO: 4815 - RNA, 18 nt, artificial
  Chemically synthesized
uaggguuuuguaaggauu

SEQ ID NO: 4816 - RNA, 18 nt, artificial
  Chemically synthesized
aggauucuuccuuggaga

SEQ ID NO: 4817 - RNA, 18 nt, artificial
  Chemically synthesized
agccugauuggaggauuc

SEQ ID NO: 4818 - RNA, 18 nt, artificial
  Chemically synthesized
gaauggaguuuaaagauc

SEQ ID NO: 4819 - RNA, 18 nt, artificial
  Chemically synthesized
accaauucccuuggauac

SEQ ID NO: 4820 - RNA, 18 nt, artificial
  Chemically synthesized
gaauaugcagccuccgga

SEQ ID NO: 4821 - RNA, 18 nt, artificial
  Chemically synthesized
agggaauggaguuuaaag

SEQ ID NO: 4822 - RNA, 18 nt, artificial
  Chemically synthesized
gaaaaagaaucuuccucu

SEQ ID NO: 4823 - RNA, 18 nt, artificial
  Chemically synthesized
uaauuugcuggccaauca

SEQ ID NO: 4824 - RNA, 18 nt, artificial
  Chemically synthesized
cuuuaucgcagcucucag

SEQ ID NO: 4825 - RNA, 18 nt, artificial
  Chemically synthesized
aauuuguuucaccagugg

SEQ ID NO: 4826 - RNA, 18 nt, artificial
  Chemically synthesized
acuguguauucgugugcu

SEQ ID NO: 4827 - RNA, 18 nt, artificial
  Chemically synthesized
aauagcaacaaguuuugg

SEQ ID NO: 4828 - RNA, 18 nt, artificial
  Chemically synthesized
cucuaaaauuaccaacuc

SEQ ID NO: 4829 - RNA, 18 nt, artificial
  Chemically synthesized
aaauccuucccgcugagc

SEQ ID NO: 4830 - RNA, 18 nt, artificial
  Chemically synthesized
cuuucaucggugauuuuc

SEQ ID NO: 4831 - RNA, 18 nt, artificial
  Chemically synthesized
gucauugagaaucuuaag

SEQ ID NO: 4832 - RNA, 18 nt, artificial
  Chemically synthesized
uucugcauccaugaaguc

SEQ ID NO: 4833 - RNA, 18 nt, artificial
  Chemically synthesized
cuugcagauaccauugcg

SEQ ID NO: 4834 - RNA, 18 nt, artificial
  Chemically synthesized
cagcuagguaggacagag

SEQ ID NO: 4835 - RNA, 18 nt, artificial
  Chemically synthesized
aguugaaagcagugaaag

SEQ ID NO: 4836 - RNA, 18 nt, artificial
  Chemically synthesized
ucaaggaagguaagucca

SEQ ID NO: 4837 - RNA, 18 nt, artificial
  Chemically synthesized
acuguugcuaauguaggu

SEQ ID NO: 4838 - RNA, 18 nt, artificial
  Chemically synthesized
uggucuuaaauaugggaa

SEQ ID NO: 4839 - RNA, 18 nt, artificial
  Chemically synthesized
accagaaaaacuuuacug

SEQ ID NO: 4840 - RNA, 18 nt, artificial
  Chemically synthesized
uaggugauccuguuguug

SEQ ID NO: 4841 - RNA, 18 nt, artificial
  Chemically synthesized
agugaauauaaagugcuc

SEQ ID NO: 4842 - RNA, 18 nt, artificial
  Chemically synthesized
uuguugcucuugagauca

SEQ ID NO: 4843 - RNA, 18 nt, artificial
  Chemically synthesized
aaggaaccagaaaaacuu

SEQ ID NO: 4844 - RNA, 18 nt, artificial
  Chemically synthesized
aaguguccaaaucaguau

SEQ ID NO: 4845 - RNA, 18 nt, artificial
  Chemically synthesized
auggaaaguguccaaauc

SEQ ID NO: 4846 - RNA, 18 nt, artificial
  Chemically synthesized
agagcacagcacaugcca

SEQ ID NO: 4847 - RNA, 18 nt, artificial
  Chemically synthesized
ucauuaucagaugcucua

SEQ ID NO: 4848 - RNA, 18 nt, artificial
  Chemically synthesized
agagcuccugggagucac

SEQ ID NO: 4849 - RNA, 18 nt, artificial
  Chemically synthesized
gagcuuuccugggcuucc

SEQ ID NO: 4850 - RNA, 18 nt, artificial
  Chemically synthesized
cucacaggcugaauuuuu

SEQ ID NO: 4851 - RNA, 18 nt, artificial
  Chemically synthesized
ugaacuaagccaguugcu

SEQ ID NO: 4852 - RNA, 18 nt, artificial
  Chemically synthesized
uaugcugcuucauaugaa

SEQ ID NO: 4853 - RNA, 18 nt, artificial
  Chemically synthesized
ugagaugagaaaaaagag

SEQ ID NO: 4854 - RNA, 18 nt, artificial
  Chemically synthesized
cacccaguaggcaucccg

SEQ ID NO: 4855 - RNA, 18 nt, artificial
  Chemically synthesized
agccuguuacacugugua

SEQ ID NO: 4856 - RNA, 18 nt, artificial
  Chemically synthesized
uuaaguucauuugugcug

SEQ ID NO: 4857 - RNA, 18 nt, artificial
  Chemically synthesized
ugaaaaauggaaaguguc

SEQ ID NO: 4858 - RNA, 18 nt, artificial
  Chemically synthesized
cggaaaugggagaagucc

SEQ ID NO: 4859 - RNA, 18 nt, artificial
  Chemically synthesized
uuucaggcauagaaugaa

SEQ ID NO: 4860 - RNA, 18 nt, artificial
  Chemically synthesized
aacaaacuuucaucggug

SEQ ID NO: 4861 - RNA, 18 nt, artificial
  Chemically synthesized
ucacacagguaauuugcu

SEQ ID NO: 4862 - RNA, 18 nt, artificial
  Chemically synthesized
ugaagcaucaaucucaag

SEQ ID NO: 4863 - RNA, 18 nt, artificial
  Chemically synthesized
guucugaaaaauggaaag

SEQ ID NO: 4864 - RNA, 18 nt, artificial
  Chemically synthesized
ggagaacuccgagcaguc

SEQ ID NO: 4865 - RNA, 18 nt, artificial
  Chemically synthesized
ccaggaaugaagucccgc

SEQ ID NO: 4866 - RNA, 18 nt, artificial
  Chemically synthesized
cuuggucacuaagagcuc

SEQ ID NO: 4867 - RNA, 18 nt, artificial
  Chemically synthesized
caaguccucaaaugacgg

SEQ ID NO: 4868 - RNA, 18 nt, artificial
  Chemically synthesized
aacccacaacuaccaguu

SEQ ID NO: 4869 - RNA, 18 nt, artificial
  Chemically synthesized
uggcucuuuucaauggag

SEQ ID NO: 4870 - RNA, 18 nt, artificial
  Chemically synthesized
gaucuauaacucugucau

SEQ ID NO: 4871 - RNA, 18 nt, artificial
  Chemically synthesized
uccagcaguaaaauaugc

SEQ ID NO: 4872 - RNA, 18 nt, artificial
  Chemically synthesized
gaaaugggagaaguccag

SEQ ID NO: 4873 - RNA, 18 nt, artificial
  Chemically synthesized
agauguuccugcugggag

SEQ ID NO: 4874 - RNA, 18 nt, artificial
  Chemically synthesized
aaucucaaguuccucaag

SEQ ID NO: 4875 - RNA, 18 nt, artificial
  Chemically synthesized
aaaaauggaaagugucca

SEQ ID NO: 4876 - RNA, 18 nt, artificial
  Chemically synthesized
ccaauucccuuggauacc

SEQ ID NO: 4877 - RNA, 18 nt, artificial
  Chemically synthesized
ccaauuuuuaaaucuggc

SEQ ID NO: 4878 - RNA, 18 nt, artificial
  Chemically synthesized
ccaacuccauuaagggua

SEQ ID NO: 4879 - RNA, 18 nt, artificial
  Chemically synthesized
augaauuuguuucaccag

SEQ ID NO: 4880 - RNA, 18 nt, artificial
  Chemically synthesized
cagauaccauugcgguca

SEQ ID NO: 4881 - RNA, 18 nt, artificial
  Chemically synthesized
ugcaaccaauucccuugg

SEQ ID NO: 4882 - RNA, 18 nt, artificial
  Chemically synthesized
uuccuuggagaggcugau

SEQ ID NO: 4883 - RNA, 18 nt, artificial
  Chemically synthesized
agcucucagauuuaccca

SEQ ID NO: 4884 - RNA, 18 nt, artificial
  Chemically synthesized
augaaguuauugccacca

SEQ ID NO: 4885 - RNA, 18 nt, artificial
  Chemically synthesized
ugcuguccugugacauuc

SEQ ID NO: 4886 - RNA, 18 nt, artificial
  Chemically synthesized
aauacuaguaacaugggu

SEQ ID NO: 4887 - RNA, 18 nt, artificial
  Chemically synthesized
ugcuguuuccuaaugaac

SEQ ID NO: 4888 - RNA, 18 nt, artificial
  Chemically synthesized
aucuacaaaaaucuccag

SEQ ID NO: 4889 - RNA, 18 nt, artificial
  Chemically synthesized
auugagauuguuguugcu

SEQ ID NO: 4890 - RNA, 18 nt, artificial
  Chemically synthesized
uucacaggagcaaaugaa

SEQ ID NO: 4891 - RNA, 18 nt, artificial
  Chemically synthesized
gcaaugggcacaaugagc

SEQ ID NO: 4892 - RNA, 18 nt, artificial
  Chemically synthesized
ugcuggccacgcacaugg

SEQ ID NO: 4893 - RNA, 18 nt, artificial
  Chemically synthesized
aggccauggaaacggugg

SEQ ID NO: 4894 - RNA, 18 nt, artificial
  Chemically synthesized
gauucuuccuuggagagg

SEQ ID NO: 4895 - RNA, 18 nt, artificial
  Chemically synthesized
uuggaugucagcaccaga

SEQ ID NO: 4896 - RNA, 18 nt, artificial
  Chemically synthesized
ucucaaguuccucaagga

SEQ ID NO: 4897 - RNA, 18 nt, artificial
  Chemically synthesized
aacuccgagcagucaccu

SEQ ID NO: 4898 - RNA, 18 nt, artificial
  Chemically synthesized
uuugccuuguugcucuug

SEQ ID NO: 4899 - RNA, 18 nt, artificial
  Chemically synthesized
agguaccuucacuugguc

SEQ ID NO: 4900 - RNA, 18 nt, artificial
  Chemically synthesized
acauccugaaccugcugg

SEQ ID NO: 4901 - RNA, 18 nt, artificial
  Chemically synthesized
ugugacauuccgacaccg

SEQ ID NO: 4902 - RNA, 18 nt, artificial
  Chemically synthesized
guuuaaagauccugagcu

SEQ ID NO: 4903 - RNA, 18 nt, artificial
  Chemically synthesized
caugaagucaaccaacug

SEQ ID NO: 4904 - RNA, 18 nt, artificial
  Chemically synthesized
gcaucugguagagucauc

SEQ ID NO: 4905 - RNA, 18 nt, artificial
  Chemically synthesized
aauaugcagccuccggau

SEQ ID NO: 4906 - RNA, 18 nt, artificial
  Chemically synthesized
ggaagaaaaagaaucuuc

SEQ ID NO: 4907 - RNA, 18 nt, artificial
  Chemically synthesized
uauguggcauuguccagu

SEQ ID NO: 4908 - RNA, 18 nt, artificial
  Chemically synthesized
caaggaaccagaaaaacu

SEQ ID NO: 4909 - RNA, 18 nt, artificial
  Chemically synthesized
agacggaaaugggagaag

SEQ ID NO: 4910 - RNA, 18 nt, artificial
  Chemically synthesized
uagagagggccaggcauc

SEQ ID NO: 4911 - RNA, 18 nt, artificial
  Chemically synthesized
agcugcccuugcagauac

SEQ ID NO: 4912 - RNA, 18 nt, artificial
  Chemically synthesized
aacagagcacagcacaug

SEQ ID NO: 4913 - RNA, 18 nt, artificial
  Chemically synthesized
aaacaaacuuucaucggu

SEQ ID NO: 4914 - RNA, 18 nt, artificial
  Chemically synthesized
uucacuuggucacuaaga

SEQ ID NO: 4915 - RNA, 18 nt, artificial
  Chemically synthesized
accagagccuggagguuc

SEQ ID NO: 4916 - RNA, 18 nt, artificial
  Chemically synthesized
auccacuugccaggaaug

SEQ ID NO: 4917 - RNA, 18 nt, artificial
  Chemically synthesized
ucucuuagcaggaagaaa

SEQ ID NO: 4918 - RNA, 18 nt, artificial
  Chemically synthesized
aaugagaauggcagcauc

SEQ ID NO: 4919 - RNA, 18 nt, artificial
  Chemically synthesized
auagcucuguagaucuga

SEQ ID NO: 4920 - RNA, 18 nt, artificial
  Chemically synthesized
ucaaguugcuccuuagaa

SEQ ID NO: 4921 - RNA, 18 nt, artificial
  Chemically synthesized
caccucuguaggucacug

SEQ ID NO: 4922 - RNA, 18 nt, artificial
  Chemically synthesized
ugccuuuuguggccacag

SEQ ID NO: 4923 - RNA, 18 nt, artificial
  Chemically synthesized
uaaagugcucagaucaua

SEQ ID NO: 4924 - RNA, 18 nt, artificial
  Chemically synthesized
ugggagaacuccgagcag

SEQ ID NO: 4925 - RNA, 18 nt, artificial
  Chemically synthesized
gagcaaaugaaguuauug

SEQ ID NO: 4926 - RNA, 18 nt, artificial
  Chemically synthesized
acuugccaggaaugaagu

SEQ ID NO: 4927 - RNA, 18 nt, artificial
  Chemically synthesized
aacuguggaucaaaagua

SEQ ID NO: 4928 - RNA, 18 nt, artificial
  Chemically synthesized
gucacuaagagcuccugg

SEQ ID NO: 4929 - RNA, 18 nt, artificial
  Chemically synthesized
uguccugugacauuccga

SEQ ID NO: 4930 - RNA, 18 nt, artificial
  Chemically synthesized
gccagugcuugcugcucc

SEQ ID NO: 4931 - RNA, 18 nt, artificial
  Chemically synthesized
acaaaguuuucagaaagc

SEQ ID NO: 4932 - RNA, 18 nt, artificial
  Chemically synthesized
ggaauagcaacaaguuuu

SEQ ID NO: 4933 - RNA, 18 nt, artificial
  Chemically synthesized
uguaggucacuguugcua

SEQ ID NO: 4934 - RNA, 18 nt, artificial
  Chemically synthesized
ugcuggauaaguucaaau

SEQ ID NO: 4935 - RNA, 18 nt, artificial
  Chemically synthesized
gcaaguccucaaaugacg

SEQ ID NO: 4936 - RNA, 18 nt, artificial
  Chemically synthesized
cuccgagcagucaccuga

SEQ ID NO: 4937 - RNA, 18 nt, artificial
  Chemically synthesized
uaaugaacuaagccaguu

SEQ ID NO: 4938 - RNA, 18 nt, artificial
  Chemically synthesized
gcaggaagaaagaaugac

SEQ ID NO: 4939 - RNA, 18 nt, artificial
  Chemically synthesized
ucuugagaucagcugcac

SEQ ID NO: 4940 - RNA, 18 nt, artificial
  Chemically synthesized
acggaaaugggagaaguc

SEQ ID NO: 4941 - RNA, 18 nt, artificial
  Chemically synthesized
ucaaggcuuuuuacagcu

SEQ ID NO: 4942 - RNA, 18 nt, artificial
  Chemically synthesized
uacaaaaaucuccagcag

SEQ ID NO: 4943 - RNA, 18 nt, artificial
  Chemically synthesized
caucaaucucaaguuccu

SEQ ID NO: 4944 - RNA, 18 nt, artificial
  Chemically synthesized
gaucugaagcaucaaucu

SEQ ID NO: 4945 - RNA, 18 nt, artificial
  Chemically synthesized
guucacacaccucuguag

SEQ ID NO: 4946 - RNA, 18 nt, artificial
  Chemically synthesized
agucacuauaggucuccu

SEQ ID NO: 4947 - RNA, 18 nt, artificial
  Chemically synthesized
uugagauuguuguugcua

SEQ ID NO: 4948 - RNA, 18 nt, artificial
  Chemically synthesized
uggaucuauaacucuguc

SEQ ID NO: 4949 - RNA, 18 nt, artificial
  Chemically synthesized
cccuugcagauaccauug

SEQ ID NO: 4950 - RNA, 18 nt, artificial
  Chemically synthesized
aagaaugagaauggcagc

SEQ ID NO: 4951 - RNA, 18 nt, artificial
  Chemically synthesized
gcagugaaagagcaaugg

SEQ ID NO: 4952 - RNA, 18 nt, artificial
  Chemically synthesized
acauggguaagagggagg

SEQ ID NO: 4953 - RNA, 18 nt, artificial
  Chemically synthesized
auaugaaggaucagauga

SEQ ID NO: 4954 - RNA, 18 nt, artificial
  Chemically synthesized
guaaaaccuuggaauaug

SEQ ID NO: 4955 - RNA, 18 nt, artificial
  Chemically synthesized
uaccaguugaaagcagug

SEQ ID NO: 4956 - RNA, 18 nt, artificial
  Chemically synthesized
uccuuagaaaacguaguu

SEQ ID NO: 4957 - RNA, 18 nt, artificial
  Chemically synthesized
ugaaguuauugccaccag

SEQ ID NO: 4958 - RNA, 18 nt, artificial
  Chemically synthesized
ugcuugcaacaccaaaca

SEQ ID NO: 4959 - RNA, 18 nt, artificial
  Chemically synthesized
cagaggagucucuuagca

SEQ ID NO: 4960 - RNA, 18 nt, artificial
  Chemically synthesized
caaugaugccaaaugauu

SEQ ID NO: 4961 - RNA, 18 nt, artificial
  Chemically synthesized
auccucacaggcugaauu

SEQ ID NO: 4962 - RNA, 18 nt, artificial
  Chemically synthesized
caacuccauuaaggguac

SEQ ID NO: 4963 - RNA, 18 nt, artificial
  Chemically synthesized
aagacccacaccauccac

SEQ ID NO: 4964 - RNA, 18 nt, artificial
  Chemically synthesized
cugcugggagcuuuccug

SEQ ID NO: 4965 - RNA, 18 nt, artificial
  Chemically synthesized
ugucagcaccagagccug

SEQ ID NO: 4966 - RNA, 18 nt, artificial
  Chemically synthesized
agcaaagucucuccgguu

SEQ ID NO: 4967 - RNA, 18 nt, artificial
  Chemically synthesized
ccaguaaguuuaagaaug

SEQ ID NO: 4968 - RNA, 18 nt, artificial
  Chemically synthesized
aggaagguaaguccagca

SEQ ID NO: 4969 - RNA, 18 nt, artificial
  Chemically synthesized
aaagacaguuuuguggcu

SEQ ID NO: 4970 - RNA, 18 nt, artificial
  Chemically synthesized
caaguuucaggcauagaa

SEQ ID NO: 4971 - RNA, 18 nt, artificial
  Chemically synthesized
acuaccaguugaaagcag

SEQ ID NO: 4972 - RNA, 18 nt, artificial
  Chemically synthesized
acaugccagacaccagug

SEQ ID NO: 4973 - RNA, 18 nt, artificial
  Chemically synthesized
aaaguguccaaaucagua

SEQ ID NO: 4974 - RNA, 18 nt, artificial
  Chemically synthesized
aguccagcaaaaucuuuu

SEQ ID NO: 4975 - RNA, 18 nt, artificial
  Chemically synthesized
cucucaggauuugcaauu

SEQ ID NO: 4976 - RNA, 18 nt, artificial
  Chemically synthesized
agauaccauugcggucac

SEQ ID NO: 4977 - RNA, 18 nt, artificial
  Chemically synthesized
gacuuuaucgcagcucuc

SEQ ID NO: 4978 - RNA, 18 nt, artificial
  Chemically synthesized
ccaccagcuuccaaaguc

SEQ ID NO: 4979 - RNA, 18 nt, artificial
  Chemically synthesized
gcugcacagagaagugac

SEQ ID NO: 4980 - RNA, 18 nt, artificial
  Chemically synthesized
gaaagaaugacacaguca

SEQ ID NO: 4981 - RNA, 18 nt, artificial
  Chemically synthesized
ccuggagguucacacacc

SEQ ID NO: 4982 - RNA, 18 nt, artificial
  Chemically synthesized
ccuguuacacuguguauu

SEQ ID NO: 4983 - RNA, 18 nt, artificial
  Chemically synthesized
cagugucuugggaaugca

SEQ ID NO: 4984 - RNA, 18 nt, artificial
  Chemically synthesized
ucucgcaguuccaaacau

SEQ ID NO: 4985 - RNA, 18 nt, artificial
  Chemically synthesized
caaaucaguaucucgcag

SEQ ID NO: 4986 - RNA, 18 nt, artificial
  Chemically synthesized
cuugcaccacucacucuu

SEQ ID NO: 4987 - RNA, 18 nt, artificial
  Chemically synthesized
cgguuuuuuccaaugaug

SEQ ID NO: 4988 - RNA, 18 nt, artificial
  Chemically synthesized
acgguacauccacguagu

SEQ ID NO: 4989 - RNA, 18 nt, artificial
  Chemically synthesized
ugucugaaugaacuuaac

SEQ ID NO: 4990 - RNA, 18 nt, artificial
  Chemically synthesized
acagguaauuugcuggcc

SEQ ID NO: 4991 - RNA, 18 nt, artificial
  Chemically synthesized
cuuguugcucuugagauc

SEQ ID NO: 4992 - RNA, 18 nt, artificial
  Chemically synthesized
ccacagguaccuucacuu

SEQ ID NO: 4993 - RNA, 18 nt, artificial
  Chemically synthesized
gugacauaaagaucccaa

SEQ ID NO: 4994 - RNA, 18 nt, artificial
  Chemically synthesized
agguucuccacccaguag

SEQ ID NO: 4995 - RNA, 18 nt, artificial
  Chemically synthesized
uugcggcaaauucaaaga

SEQ ID NO: 4996 - RNA, 18 nt, artificial
  Chemically synthesized
cacagucauugagaaucu

SEQ ID NO: 4997 - RNA, 18 nt, artificial
  Chemically synthesized
cagguaccuucacuuggu

SEQ ID NO: 4998 - RNA, 18 nt, artificial
  Chemically synthesized
uguaggugauccuguugu

SEQ ID NO: 4999 - RNA, 18 nt, artificial
  Chemically synthesized
gaaugcagccuguuacac

SEQ ID NO: 5000 - RNA, 18 nt, artificial
  Chemically synthesized
cggacauccugaaccugc

SEQ ID NO: 5001 - RNA, 18 nt, artificial
  Chemically synthesized
cuccugagugaaggagag

SEQ ID NO: 5002 - RNA, 18 nt, artificial
  Chemically synthesized
ccuuggauaccaagggac

SEQ ID NO: 5003 - RNA, 18 nt, artificial
  Chemically synthesized
caaaguuuucagaaagca

SEQ ID NO: 5004 - RNA, 18 nt, artificial
  Chemically synthesized
cagccuguuacacugugu

SEQ ID NO: 5005 - RNA, 18 nt, artificial
  Chemically synthesized
aaacuuucaucggugauu

SEQ ID NO: 5006 - RNA, 18 nt, artificial
  Chemically synthesized
aagcagugaaagagcaau

SEQ ID NO: 5007 - RNA, 18 nt, artificial
  Chemically synthesized
caugccagacaccagugc

SEQ ID NO: 5008 - RNA, 18 nt, artificial
  Chemically synthesized
caguugcuacagauuaca

SEQ ID NO: 5009 - RNA, 18 nt, artificial
  Chemically synthesized
acauuccacggaacuugu

SEQ ID NO: 5010 - RNA, 18 nt, artificial
  Chemically synthesized
uccaugggccacuccagg

SEQ ID NO: 5011 - RNA, 18 nt, artificial
  Chemically synthesized
acauaaagaucccaacua

SEQ ID NO: 5012 - RNA, 18 nt, artificial
  Chemically synthesized
cagcuugcagaagcgcug

SEQ ID NO: 5013 - RNA, 18 nt, artificial
  Chemically synthesized
cacaggccauggaaacgg

SEQ ID NO: 5014 - RNA, 18 nt, artificial
  Chemically synthesized
aagacuuuggccagugcu

SEQ ID NO: 5015 - RNA, 18 nt, artificial
  Chemically synthesized
uccugugacauuccgaca

SEQ ID NO: 5016 - RNA, 18 nt, artificial
  Chemically synthesized
ucaaugggcuccagaaga

SEQ ID NO: 5017 - RNA, 18 nt, artificial
  Chemically synthesized
aauggaaaguguccaaau

SEQ ID NO: 5018 - RNA, 18 nt, artificial
  Chemically synthesized
acccaguaggcaucccgc

SEQ ID NO: 5019 - RNA, 18 nt, artificial
  Chemically synthesized
aagccugauuggaggauu

SEQ ID NO: 5020 - RNA, 18 nt, artificial
  Chemically synthesized
cuaccaguugaaagcagu

SEQ ID NO: 5021 - RNA, 18 nt, artificial
  Chemically synthesized
agcaccagagccuggagg

SEQ ID NO: 5022 - RNA, 18 nt, artificial
  Chemically synthesized
cacucucaggauuugcaa

SEQ ID NO: 5023 - RNA, 18 nt, artificial
  Chemically synthesized
uccuucccgcugagccuc

SEQ ID NO: 5024 - RNA, 18 nt, artificial
  Chemically synthesized
agucucuuagcaggaaga

SEQ ID NO: 5025 - RNA, 18 nt, artificial
  Chemically synthesized
aaaucuccagcaguaaaa

SEQ ID NO: 5026 - RNA, 18 nt, artificial
  Chemically synthesized
acaccauccacaaaguau

SEQ ID NO: 5027 - RNA, 18 nt, artificial
  Chemically synthesized
guccucaaaugacgguac

SEQ ID NO: 5028 - RNA, 18 nt, artificial
  Chemically synthesized
gucaucaacuuauuucug

SEQ ID NO: 5029 - RNA, 18 nt, artificial
  Chemically synthesized
ugccagacaccagugcug

SEQ ID NO: 5030 - RNA, 18 nt, artificial
  Chemically synthesized
gugcuugcugcuccugag

SEQ ID NO: 5031 - RNA, 18 nt, artificial
  Chemically synthesized
uuuucuggccacugacaa

SEQ ID NO: 5032 - RNA, 18 nt, artificial
  Chemically synthesized
ccagcuuccaaagucuuc

SEQ ID NO: 5033 - RNA, 18 nt, artificial
  Chemically synthesized
cccacaccauccacaaag

SEQ ID NO: 5034 - RNA, 18 nt, artificial
  Chemically synthesized
ggucuugguguucauuau

SEQ ID NO: 5035 - RNA, 18 nt, artificial
  Chemically synthesized
uaggucuugguguucauu

SEQ ID NO: 5036 - RNA, 18 nt, artificial
  Chemically synthesized
cuauaggucuccuuugga

SEQ ID NO: 5037 - RNA, 18 nt, artificial
  Chemically synthesized
auguucaagacugcccag

SEQ ID NO: 5038 - RNA, 18 nt, artificial
  Chemically synthesized
cauaagguucuccaccca

SEQ ID NO: 5039 - RNA, 18 nt, artificial
  Chemically synthesized
aggaucagaugacuuaca

SEQ ID NO: 5040 - RNA, 18 nt, artificial
  Chemically synthesized
gauggagagucacacagg

SEQ ID NO: 5041 - RNA, 18 nt, artificial
  Chemically synthesized
aggcuuuuuacagcuucu

SEQ ID NO: 5042 - RNA, 18 nt, artificial
  Chemically synthesized
cucacucuucacaaaguu

SEQ ID NO: 5043 - RNA, 18 nt, artificial
  Chemically synthesized
augagaauggcagcauca

SEQ ID NO: 5044 - RNA, 18 nt, artificial
  Chemically synthesized
uuucccacucucaggauu

SEQ ID NO: 5045 - RNA, 18 nt, artificial
  Chemically synthesized
aaaugggagaaguccagu

SEQ ID NO: 5046 - RNA, 18 nt, artificial
  Chemically synthesized
guucauuugugcuguuuc

SEQ ID NO: 5047 - RNA, 18 nt, artificial
  Chemically synthesized
uucaaacuuuuuggcuca

SEQ ID NO: 5048 - RNA, 18 nt, artificial
  Chemically synthesized
gagucaaugauauuguca

SEQ ID NO: 5049 - RNA, 18 nt, artificial
  Chemically synthesized
gcuugaaccaggaagacg

SEQ ID NO: 5050 - RNA, 18 nt, artificial
  Chemically synthesized
gugaaagagcaaugggca

SEQ ID NO: 5051 - RNA, 18 nt, artificial
  Chemically synthesized
ucaaugauccacuugcca

SEQ ID NO: 5052 - RNA, 18 nt, artificial
  Chemically synthesized
gugacagcuagguaggac

SEQ ID NO: 5053 - RNA, 18 nt, artificial
  Chemically synthesized
caaaugaaguuauugcca

SEQ ID NO: 5054 - RNA, 18 nt, artificial
  Chemically synthesized
agugugugaaaugaguca

SEQ ID NO: 5055 - RNA, 18 nt, artificial
  Chemically synthesized
cagucaccugagagaacg

SEQ ID NO: 5056 - RNA, 18 nt, artificial
  Chemically synthesized
uaggaauagcaacaaguu

SEQ ID NO: 5057 - RNA, 18 nt, artificial
  Chemically synthesized
guuccucaaggaagguaa

SEQ ID NO: 5058 - RNA, 18 nt, artificial
  Chemically synthesized
aaucaagacuuuggccag

SEQ ID NO: 5059 - RNA, 18 nt, artificial
  Chemically synthesized
uguugcuaauguagguga

SEQ ID NO: 5060 - RNA, 18 nt, artificial
  Chemically synthesized
uggguucugcauccauga

SEQ ID NO: 5061 - RNA, 18 nt, artificial
  Chemically synthesized
aggaacagagcacagcac

SEQ ID NO: 5062 - RNA, 18 nt, artificial
  Chemically synthesized
ugaaggaucagaugacuu

SEQ ID NO: 5063 - RNA, 18 nt, artificial
  Chemically synthesized
ugggcuccagaagaauga

SEQ ID NO: 5064 - RNA, 18 nt, artificial
  Chemically synthesized
ucacucuucacaaaguuu

SEQ ID NO: 5065 - RNA, 18 nt, artificial
  Chemically synthesized
cacagguaauuugcuggc

SEQ ID NO: 5066 - RNA, 18 nt, artificial
  Chemically synthesized
agcaaguccucaaaugac

SEQ ID NO: 5067 - RNA, 18 nt, artificial
  Chemically synthesized
cuugccaggaaugaaguc

SEQ ID NO: 5068 - RNA, 18 nt, artificial
  Chemically synthesized
gauguuccugcugggagc

SEQ ID NO: 5069 - RNA, 18 nt, artificial
  Chemically synthesized
gaauagcaacaaguuuug

SEQ ID NO: 5070 - RNA, 18 nt, artificial
  Chemically synthesized
agcaaugggcacaaugag

SEQ ID NO: 5071 - RNA, 18 nt, artificial
  Chemically synthesized
agauuacaguuggcccuc

SEQ ID NO: 5072 - RNA, 18 nt, artificial
  Chemically synthesized
cacaugccagacaccagu

SEQ ID NO: 5073 - RNA, 18 nt, artificial
  Chemically synthesized
ucguccaugggccacucc

SEQ ID NO: 5074 - RNA, 18 nt, artificial
  Chemically synthesized
cacggaacuuguaacauc

SEQ ID NO: 5075 - RNA, 18 nt, artificial
  Chemically synthesized
agcuuuccugggcuuccu

SEQ ID NO: 5076 - RNA, 18 nt, artificial
  Chemically synthesized
cagcuucugugagcccug

SEQ ID NO: 5077 - RNA, 18 nt, artificial
  Chemically synthesized
guaauuugcuggccaauc

SEQ ID NO: 5078 - RNA, 18 nt, artificial
  Chemically synthesized
auccaugaagucaaccaa

SEQ ID NO: 5079 - RNA, 18 nt, artificial
  Chemically synthesized
gaaaguguccaaaucagu

SEQ ID NO: 5080 - RNA, 18 nt, artificial
  Chemically synthesized
cuaggacuuuaucgcagc

SEQ ID NO: 5081 - RNA, 18 nt, artificial
  Chemically synthesized
aauuuugauauccacgag

SEQ ID NO: 5082 - RNA, 18 nt, artificial
  Chemically synthesized
ccauugcggucacaagac

SEQ ID NO: 5083 - RNA, 18 nt, artificial
  Chemically synthesized
caaacauuccacggaacu

SEQ ID NO: 5084 - RNA, 18 nt, artificial
  Chemically synthesized
uggaaaguguccaaauca

SEQ ID NO: 5085 - RNA, 18 nt, artificial
  Chemically synthesized
cacagguaccuucacuug

SEQ ID NO: 5086 - RNA, 18 nt, artificial
  Chemically synthesized
aagauccugagcugcccu

SEQ ID NO: 5087 - RNA, 18 nt, artificial
  Chemically synthesized
cuucacuuggucacuaag

SEQ ID NO: 5088 - RNA, 18 nt, artificial
  Chemically synthesized
auuccacggaacuuguaa

SEQ ID NO: 5089 - RNA, 18 nt, artificial
  Chemically synthesized
acuuuaucgcagcucuca

SEQ ID NO: 5090 - RNA, 18 nt, artificial
  Chemically synthesized
cucuucacaaaguuuuca

SEQ ID NO: 5091 - RNA, 18 nt, artificial
  Chemically synthesized
gagguucacacaccucug

SEQ ID NO: 5092 - RNA, 18 nt, artificial
  Chemically synthesized
aagucccgcuuaugaaga

SEQ ID NO: 5093 - RNA, 18 nt, artificial
  Chemically synthesized
acagagaaugccuuuugu

SEQ ID NO: 5094 - RNA, 18 nt, artificial
  Chemically synthesized
caacaccaaacacuggga

SEQ ID NO: 5095 - RNA, 18 nt, artificial
  Chemically synthesized
uugcggucacaagacaga

SEQ ID NO: 5096 - RNA, 18 nt, artificial
  Chemically synthesized
auggaaacgguggcacag

SEQ ID NO: 5097 - RNA, 18 nt, artificial
  Chemically synthesized
uuuaaagauccugagcug

SEQ ID NO: 5098 - RNA, 18 nt, artificial
  Chemically synthesized
cagcaguaaaauaugcug

SEQ ID NO: 5099 - RNA, 18 nt, artificial
  Chemically synthesized
agacaccagugcuguccu

SEQ ID NO: 5100 - RNA, 18 nt, artificial
  Chemically synthesized
guucuccagcuccuggac

SEQ ID NO: 5101 - RNA, 18 nt, artificial
  Chemically synthesized
agcuccuggaccauaagg

SEQ ID NO: 5102 - RNA, 18 nt, artificial
  Chemically synthesized
ugaauuuguuucaccagu

SEQ ID NO: 5103 - RNA, 18 nt, artificial
  Chemically synthesized
cagagaagugacagcuag

SEQ ID NO: 5104 - RNA, 18 nt, artificial
  Chemically synthesized
uggagguucacacaccuc

SEQ ID NO: 5105 - RNA, 18 nt, artificial
  Chemically synthesized
gcugcccuugcagauacc

SEQ ID NO: 5106 - RNA, 18 nt, artificial
  Chemically synthesized
gcaguuccaaacauucca

SEQ ID NO: 5107 - RNA, 18 nt, artificial
  Chemically synthesized
aguauguggcauugucca

SEQ ID NO: 5108 - RNA, 18 nt, artificial
  Chemically synthesized
ugcuccugagugaaggag

SEQ ID NO: 5109 - RNA, 18 nt, artificial
  Chemically synthesized
acuaagccaguugcuaca

SEQ ID NO: 5110 - RNA, 18 nt, artificial
  Chemically synthesized
agaagugacagcuaggua

SEQ ID NO: 5111 - RNA, 18 nt, artificial
  Chemically synthesized
aacaaaugcaucauagca

SEQ ID NO: 5112 - RNA, 18 nt, artificial
  Chemically synthesized
agaucagcugcacagaga

SEQ ID NO: 5113 - RNA, 18 nt, artificial
  Chemically synthesized
caaccaauucccuuggau

SEQ ID NO: 5114 - RNA, 18 nt, artificial
  Chemically synthesized
ucuuuucaauggagucaa

SEQ ID NO: 5115 - RNA, 18 nt, artificial
  Chemically synthesized
uggccaaucaaucaagac

SEQ ID NO: 5116 - RNA, 18 nt, artificial
  Chemically synthesized
auaugcugcuucauauga

SEQ ID NO: 5117 - RNA, 18 nt, artificial
  Chemically synthesized
caaagucucuccgguuuu

SEQ ID NO: 5118 - RNA, 18 nt, artificial
  Chemically synthesized
ugagccucguccaugggc

SEQ ID NO: 5119 - RNA, 18 nt, artificial
  Chemically synthesized
auaccaagggacuauauu

SEQ ID NO: 5120 - RNA, 18 nt, artificial
  Chemically synthesized
uggaguuuaaagauccug

SEQ ID NO: 5121 - RNA, 18 nt, artificial
  Chemically synthesized
aaccaauucccuuggaua

SEQ ID NO: 5122 - RNA, 18 nt, artificial
  Chemically synthesized
caucccgcucacuguaag

SEQ ID NO: 5123 - RNA, 18 nt, artificial
  Chemically synthesized
uggaaacgguggcacagg

SEQ ID NO: 5124 - RNA, 18 nt, artificial
  Chemically synthesized
gaucagcaggaacagagc

SEQ ID NO: 5125 - RNA, 18 nt, artificial
  Chemically synthesized
ccuugcagauaccauugc

SEQ ID NO: 5126 - RNA, 18 nt, artificial
  Chemically synthesized
acagagaagccugauugg

SEQ ID NO: 5127 - RNA, 18 nt, artificial
  Chemically synthesized
gcuuccaaagucuucagu

SEQ ID NO: 5128 - RNA, 18 nt, artificial
  Chemically synthesized
uuuuggccuggagccagg

SEQ ID NO: 5129 - RNA, 18 nt, artificial
  Chemically synthesized
guuuuguggcucuuuuca

SEQ ID NO: 5130 - RNA, 18 nt, artificial
  Chemically synthesized
ccauggaaacgguggcac

SEQ ID NO: 5131 - RNA, 18 nt, artificial
  Chemically synthesized
cugcgcuuucucgcugcc

SEQ ID NO: 5132 - RNA, 18 nt, artificial
  Chemically synthesized
aggcauccucacaggcug

SEQ ID NO: 5133 - RNA, 18 nt, artificial
  Chemically synthesized
ugcgcuuucucgcugccu

SEQ ID NO: 5134 - RNA, 18 nt, artificial
  Chemically synthesized
auccugaaccugcuggcc

SEQ ID NO: 5135 - RNA, 18 nt, artificial
  Chemically synthesized
gagaggaauucacaggag

SEQ ID NO: 5136 - RNA, 18 nt, artificial
  Chemically synthesized
agcacaugccagacacca

SEQ ID NO: 5137 - RNA, 18 nt, artificial
  Chemically synthesized
caucauuguucucaucaa

SEQ ID NO: 5138 - RNA, 18 nt, artificial
  Chemically synthesized
gaaacgguggcacaggac

SEQ ID NO: 5139 - RNA, 18 nt, artificial
  Chemically synthesized
gcacaugccagacaccag

SEQ ID NO: 5140 - RNA, 18 nt, artificial
  Chemically synthesized
ccgagaggcggacauccu

SEQ ID NO: 5141 - RNA, 18 nt, artificial
  Chemically synthesized
ucauagcagauguuccug

SEQ ID NO: 5142 - RNA, 18 nt, artificial
  Chemically synthesized
auuuguuucaccagugga

SEQ ID NO: 5143 - RNA, 18 nt, artificial
  Chemically synthesized
cgagcagccgccuggcug

SEQ ID NO: 5144 - RNA, 18 nt, artificial
  Chemically synthesized
uuuuguggccacagagga

SEQ ID NO: 5145 - RNA, 18 nt, artificial
  Chemically synthesized
caguucauacuugcacca

SEQ ID NO: 5146 - RNA, 18 nt, artificial
  Chemically synthesized
cagauuacaguuggcccu

SEQ ID NO: 5147 - RNA, 18 nt, artificial
  Chemically synthesized
aaucuccagcaguaaaau

SEQ ID NO: 5148 - RNA, 18 nt, artificial
  Chemically synthesized
gauccugagcugcccuug

SEQ ID NO: 5149 - RNA, 18 nt, artificial
  Chemically synthesized
auaccauugcggucacaa

SEQ ID NO: 5150 - RNA, 18 nt, artificial
  Chemically synthesized
gaauucacaggagcaaau

SEQ ID NO: 5151 - RNA, 18 nt, artificial
  Chemically synthesized
gucaaggcuuuuuacagc

SEQ ID NO: 5152 - RNA, 18 nt, artificial
  Chemically synthesized
ggucaaggcuuuuuacag

SEQ ID NO: 5153 - RNA, 18 nt, artificial
  Chemically synthesized
uucuccacccaguaggca

SEQ ID NO: 5154 - RNA, 18 nt, artificial
  Chemically synthesized
ucucaggauuugcaauuu

SEQ ID NO: 5155 - RNA, 18 nt, artificial
  Chemically synthesized
cuggaucuauaacucugu

SEQ ID NO: 5156 - RNA, 18 nt, artificial
  Chemically synthesized
agguaggucuugguguuc

SEQ ID NO: 5157 - RNA, 18 nt, artificial
  Chemically synthesized
uagcucuguagaucugaa

SEQ ID NO: 5158 - RNA, 18 nt, artificial
  Chemically synthesized
agaaagcacaaagacagu

SEQ ID NO: 5159 - RNA, 18 nt, artificial
  Chemically synthesized
ugcugggagcuuuccugg

SEQ ID NO: 5160 - RNA, 18 nt, artificial
  Chemically synthesized
accaaacacugggagaac

SEQ ID NO: 5161 - RNA, 18 nt, artificial
  Chemically synthesized
gucuucagugugugaaau

SEQ ID NO: 5162 - RNA, 18 nt, artificial
  Chemically synthesized
caauucccuuggauacca

SEQ ID NO: 5163 - RNA, 18 nt, artificial
  Chemically synthesized
gccacugacaaguuucag

SEQ ID NO: 5164 - RNA, 18 nt, artificial
  Chemically synthesized
uuguuaacguuuccacuu

SEQ ID NO: 5165 - RNA, 18 nt, artificial
  Chemically synthesized
ggcuuuuuacagcuucug

SEQ ID NO: 5166 - RNA, 18 nt, artificial
  Chemically synthesized
auuuccagugucuuggga

SEQ ID NO: 5167 - RNA, 18 nt, artificial
  Chemically synthesized
auccagaaaucugauuca

SEQ ID NO: 5168 - RNA, 18 nt, artificial
  Chemically synthesized
aaagucuucaguguguga

SEQ ID NO: 5169 - RNA, 18 nt, artificial
  Chemically synthesized
gaauggcuuuuuucucaa

SEQ ID NO: 5170 - RNA, 18 nt, artificial
  Chemically synthesized
ggugauuuucacauuucu

SEQ ID NO: 5171 - RNA, 18 nt, artificial
  Chemically synthesized
aaugggcuccagaagaau

SEQ ID NO: 5172 - RNA, 18 nt, artificial
  Chemically synthesized
uuucccaguaaguuuaag

SEQ ID NO: 5173 - RNA, 18 nt, artificial
  Chemically synthesized
aaguugcuccuuagaaaa

SEQ ID NO: 5174 - RNA, 18 nt, artificial
  Chemically synthesized
acaccaaacacugggaga

SEQ ID NO: 5175 - RNA, 18 nt, artificial
  Chemically synthesized
cccacagguaccuucacu

SEQ ID NO: 5176 - RNA, 18 nt, artificial
  Chemically synthesized
ugaagucccgcuuaugaa

SEQ ID NO: 5177 - RNA, 18 nt, artificial
  Chemically synthesized
gaaauacacagcacuuuu

SEQ ID NO: 5178 - RNA, 18 nt, artificial
  Chemically synthesized
uguggaucaaaaguaugu

SEQ ID NO: 5179 - RNA, 18 nt, artificial
  Chemically synthesized
uggguaagagggaggcau

SEQ ID NO: 5180 - RNA, 18 nt, artificial
  Chemically synthesized
aggaaugaagucccgcuu

SEQ ID NO: 5181 - RNA, 18 nt, artificial
  Chemically synthesized
agagggccaggcauccuc

SEQ ID NO: 5182 - RNA, 18 nt, artificial
  Chemically synthesized
ugaaagagcaaugggcac

SEQ ID NO: 5183 - RNA, 18 nt, artificial
  Chemically synthesized
caguuuuguggcucuuuu

SEQ ID NO: 5184 - RNA, 18 nt, artificial
  Chemically synthesized
agacagagaagccugauu

SEQ ID NO: 5185 - RNA, 18 nt, artificial
  Chemically synthesized
uaagagcuccugggaguc

SEQ ID NO: 5186 - RNA, 18 nt, artificial
  Chemically synthesized
aguuucauaaccugaaac

SEQ ID NO: 5187 - RNA, 18 nt, artificial
  Chemically synthesized
gaguuuaaagauccugag

SEQ ID NO: 5188 - RNA, 18 nt, artificial
  Chemically synthesized
ccgugagcaggaucagca

SEQ ID NO: 5189 - RNA, 18 nt, artificial
  Chemically synthesized
agaaugagaauggcagca

SEQ ID NO: 5190 - RNA, 18 nt, artificial
  Chemically synthesized
cagaagaaugagaauggc

SEQ ID NO: 5191 - RNA, 18 nt, artificial
  Chemically synthesized
aaagucucuccgguuuuu

SEQ ID NO: 5192 - RNA, 18 nt, artificial
  Chemically synthesized
agucuucagugugugaaa

SEQ ID NO: 5193 - RNA, 18 nt, artificial
  Chemically synthesized
gccaaucaaucaagacuu

SEQ ID NO: 5194 - RNA, 18 nt, artificial
  Chemically synthesized
guguccaaaucaguaucu

SEQ ID NO: 5195 - RNA, 18 nt, artificial
  Chemically synthesized
agaaucuuccucuauugu

SEQ ID NO: 5196 - RNA, 18 nt, artificial
  Chemically synthesized
uuucaccaguggauaguu

SEQ ID NO: 5197 - RNA, 18 nt, artificial
  Chemically synthesized
uuuggauccugcuugcaa

SEQ ID NO: 5198 - RNA, 18 nt, artificial
  Chemically synthesized
ugcauccaugaagucaac

SEQ ID NO: 5199 - RNA, 18 nt, artificial
  Chemically synthesized
uaaguccagcaaaaucuu

SEQ ID NO: 5200 - RNA, 18 nt, artificial
  Chemically synthesized
auauaccacaggccaugg

SEQ ID NO: 5201 - RNA, 18 nt, artificial
  Chemically synthesized
ggcauagaaugaaaacua

SEQ ID NO: 5202 - RNA, 18 nt, artificial
  Chemically synthesized
uuuggccagugcuugcug

SEQ ID NO: 5203 - RNA, 18 nt, artificial
  Chemically synthesized
aaugccuuuuguggccac

SEQ ID NO: 5204 - RNA, 18 nt, artificial
  Chemically synthesized
accacucacucuucacaa

SEQ ID NO: 5205 - RNA, 18 nt, artificial
  Chemically synthesized
aguugcuccuuagaaaac

SEQ ID NO: 5206 - RNA, 18 nt, artificial
  Chemically synthesized
gcugcgcuuucucgcugc

SEQ ID NO: 5207 - RNA, 18 nt, artificial
  Chemically synthesized
gguaccuucacuugguca

SEQ ID NO: 5208 - RNA, 18 nt, artificial
  Chemically synthesized
aagcacaaagacaguuuu

SEQ ID NO: 5209 - RNA, 18 nt, artificial
  Chemically synthesized
gagcacagcacaugccag

SEQ ID NO: 5210 - RNA, 18 nt, artificial
  Chemically synthesized
gccuggcugcgcuuucuc

SEQ ID NO: 5211 - RNA, 18 nt, artificial
  Chemically synthesized
gucaaguuuuucagagug

SEQ ID NO: 5212 - RNA, 18 nt, artificial
  Chemically synthesized
ugugaaaugagucaaguu

SEQ ID NO: 5213 - RNA, 18 nt, artificial
  Chemically synthesized
ccuggcugcgcuuucucg

SEQ ID NO: 5214 - RNA, 18 nt, artificial
  Chemically synthesized
gcaggaacagagcacagc

SEQ ID NO: 5215 - RNA, 18 nt, artificial
  Chemically synthesized
uuggacaggucaaggcuu

SEQ ID NO: 5216 - RNA, 18 nt, artificial
  Chemically synthesized
ggaaaugggagaagucca

SEQ ID NO: 5217 - RNA, 18 nt, artificial
  Chemically synthesized
cuuuccugggcuuccuuu

SEQ ID NO: 5218 - RNA, 18 nt, artificial
  Chemically synthesized
gacaaagacuggucuuaa

SEQ ID NO: 5219 - RNA, 18 nt, artificial
  Chemically synthesized
ggagucacuauaggucuc

SEQ ID NO: 5220 - RNA, 18 nt, artificial
  Chemically synthesized
agucaccugagagaacgc

SEQ ID NO: 5221 - RNA, 18 nt, artificial
  Chemically synthesized
ugagcugcccuugcagau

SEQ ID NO: 5222 - RNA, 18 nt, artificial
  Chemically synthesized
aggagucucuuagcagga

SEQ ID NO: 5223 - RNA, 18 nt, artificial
  Chemically synthesized
ugcagccuguuacacugu

SEQ ID NO: 5224 - RNA, 18 nt, artificial
  Chemically synthesized
cguaguuauugcauuccu

SEQ ID NO: 5225 - RNA, 18 nt, artificial
  Chemically synthesized
cuggucuuaaauauggga

SEQ ID NO: 5226 - RNA, 18 nt, artificial
  Chemically synthesized
ccuuguugcucuugagau

SEQ ID NO: 5227 - RNA, 18 nt, artificial
  Chemically synthesized
gucacuguugcuaaugua

SEQ ID NO: 5228 - RNA, 18 nt, artificial
  Chemically synthesized
auucacaggagcaaauga

SEQ ID NO: 5229 - RNA, 18 nt, artificial
  Chemically synthesized
cugagagaacgccgagca

SEQ ID NO: 5230 - RNA, 18 nt, artificial
  Chemically synthesized
acaaggaaccagaaaaac

SEQ ID NO: 5231 - RNA, 18 nt, artificial
  Chemically synthesized
uuccaaacauuccacgga

SEQ ID NO: 5232 - RNA, 18 nt, artificial
  Chemically synthesized
aucuuuucuggccacuga

SEQ ID NO: 5233 - RNA, 18 nt, artificial
  Chemically synthesized
gaggauccugcaaccaau

SEQ ID NO: 5234 - RNA, 18 nt, artificial
  Chemically synthesized
cagucauugagaaucuua

SEQ ID NO: 5235 - RNA, 18 nt, artificial
  Chemically synthesized
gcuuucucgcugccuccg

SEQ ID NO: 5236 - RNA, 18 nt, artificial
  Chemically synthesized
gcacaaagacaguuuugu

SEQ ID NO: 5237 - RNA, 18 nt, artificial
  Chemically synthesized
guaucucgcaguuccaaa

SEQ ID NO: 5238 - RNA, 18 nt, artificial
  Chemically synthesized
aaucaguaucucgcaguu

SEQ ID NO: 5239 - RNA, 18 nt, artificial
  Chemically synthesized
acacaccucuguagguca

SEQ ID NO: 5240 - RNA, 18 nt, artificial
  Chemically synthesized
agcacaaagacaguuuug

SEQ ID NO: 5241 - RNA, 18 nt, artificial
  Chemically synthesized
acucacucuucacaaagu

SEQ ID NO: 5242 - RNA, 18 nt, artificial
  Chemically synthesized
uugggaaugcagccuguu

SEQ ID NO: 5243 - RNA, 18 nt, artificial
  Chemically synthesized
cagcacaugccagacacc

SEQ ID NO: 5244 - RNA, 18 nt, artificial
  Chemically synthesized
ggccauggaaacgguggc

SEQ ID NO: 5245 - RNA, 18 nt, artificial
  Chemically synthesized
ucaaccaacuguggauca

SEQ ID NO: 5246 - RNA, 18 nt, artificial
  Chemically synthesized
gcagcuugcagaagcgcu

SEQ ID NO: 5247 - RNA, 18 nt, artificial
  Chemically synthesized
cucuuucuguaagugaau

SEQ ID NO: 5248 - RNA, 18 nt, artificial
  Chemically synthesized
acaaagacuggucuuaaa

SEQ ID NO: 5249 - RNA, 18 nt, artificial
  Chemically synthesized
gggaauggaguuuaaaga

SEQ ID NO: 5250 - RNA, 18 nt, artificial
  Chemically synthesized
acuaagagcuccugggag

SEQ ID NO: 5251 - RNA, 18 nt, artificial
  Chemically synthesized
ccuggaucuauaacucug

SEQ ID NO: 5252 - RNA, 18 nt, artificial
  Chemically synthesized
cacagcacuuuuuucuag

SEQ ID NO: 5253 - RNA, 18 nt, artificial
  Chemically synthesized
aguccucaaaugacggua

SEQ ID NO: 5254 - RNA, 18 nt, artificial
  Chemically synthesized
uucgugugcuggauaagu

SEQ ID NO: 5255 - RNA, 18 nt, artificial
  Chemically synthesized
ugauccuguuguuggaca

SEQ ID NO: 5256 - RNA, 18 nt, artificial
  Chemically synthesized
caccacucacucuucaca

SEQ ID NO: 5257 - RNA, 18 nt, artificial
  Chemically synthesized
cccucuauauccaugggu

SEQ ID NO: 5258 - RNA, 18 nt, artificial
  Chemically synthesized
auguaggugauccuguug

SEQ ID NO: 5259 - RNA, 18 nt, artificial
  Chemically synthesized
ccuuuuguggccacagag

SEQ ID NO: 5260 - RNA, 18 nt, Artificial Sequence
  Chemically synthesized
augaagucccgcuuauga

SEQ ID NO: 5261 - RNA, 18 nt, artificial
  Chemically synthesized
ugaacaccaagaccuacc

SEQ ID NO: 5262 - RNA, 18 nt, artificial
  Chemically synthesized
gccucccucuuacccaug

SEQ ID NO: 5263 - RNA, 18 nt, artificial
  Chemically synthesized
agaaaagauuuugcugga

SEQ ID NO: 5264 - RNA, 18 nt, artificial
  Chemically synthesized
ugcaagggcagcucagga

SEQ ID NO: 5265 - RNA, 18 nt, artificial
  Chemically synthesized
gacuccauugaaaagagc

SEQ ID NO: 5266 - RNA, 18 nt, artificial
  Chemically synthesized
caguagaaaacaguaaag

SEQ ID NO: 5267 - RNA, 18 nt, artificial
  Chemically synthesized
ugaacuggacuucuccca

SEQ ID NO: 5268 - RNA, 18 nt, artificial
  Chemically synthesized
auccuucauaugaagcag

SEQ ID NO: 5269 - RNA, 18 nt, artificial
  Chemically synthesized
cuccaggccaaaaggaag

SEQ ID NO: 5270 - RNA, 18 nt, artificial
  Chemically synthesized
uggcccucucuacaaacu

SEQ ID NO: 5271 - RNA, 18 nt, artificial
  Chemically synthesized
agauucuuuuucuucccu

SEQ ID NO: 5272 - RNA, 18 nt, artificial
  Chemically synthesized
auaacuucauuugcuccu

SEQ ID NO: 5273 - RNA, 18 nt, artificial
  Chemically synthesized
guaaaguuuuucugguuc

SEQ ID NO: 5274 - RNA, 18 nt, artificial
  Chemically synthesized
aagacuuuggaagcuggu

SEQ ID NO: 5275 - RNA, 18 nt, artificial
  Chemically synthesized
agcagcauauuuuacugc

SEQ ID NO: 5276 - RNA, 18 nt, artificial
  Chemically synthesized
aaguugaugacucuacca

SEQ ID NO: 5277 - RNA, 18 nt, artificial
  Chemically synthesized
aaaucaccgaugaaaguu

SEQ ID NO: 5278 - RNA, 18 nt, artificial
  Chemically synthesized
agcccaggaaagcuccca

SEQ ID NO: 5279 - RNA, 18 nt, artificial
  Chemically synthesized
ugacucuaccagaugccu

SEQ ID NO: 5280 - RNA, 18 nt, artificial
  Chemically synthesized
ucucaucucacaaaauug

SEQ ID NO: 5281 - RNA, 18 nt, artificial
  Chemically synthesized
aaguuccguggaauguuu

SEQ ID NO: 5282 - RNA, 18 nt, artificial
  Chemically synthesized
augaacaccaagaccuac

SEQ ID NO: 5283 - RNA, 18 nt, artificial
  Chemically synthesized
gucuucauaagcgggacu

SEQ ID NO: 5284 - RNA, 18 nt, artificial
  Chemically synthesized
ucccauuuccgucuuuuu

SEQ ID NO: 5285 - RNA, 18 nt, artificial
  Chemically synthesized
uuucugguuccuuguuua

SEQ ID NO: 5286 - RNA, 18 nt, artificial
  Chemically synthesized
ugacuccauugaaaagag

SEQ ID NO: 5287 - RNA, 18 nt, artificial
  Chemically synthesized
uauggacaccuucacuaa

SEQ ID NO: 5288 - RNA, 18 nt, artificial
  Chemically synthesized
cugugugacucuccaucc

SEQ ID NO: 5289 - RNA, 18 nt, artificial
  Chemically synthesized
aacacaauagaggaagau

SEQ ID NO: 5290 - RNA, 18 nt, artificial
  Chemically synthesized
cucuccaaggaagaaucc

SEQ ID NO: 5291 - RNA, 18 nt, artificial
  Chemically synthesized
aaguugugucuucauaag

SEQ ID NO: 5292 - RNA, 18 nt, artificial
  Chemically synthesized
aacuucauuugcuccugu

SEQ ID NO: 5293 - RNA, 18 nt, artificial
  Chemically synthesized
uugaugacucuaccagau

SEQ ID NO: 5294 - RNA, 18 nt, artificial
  Chemically synthesized
ucuuacagugagcgggau

SEQ ID NO: 5295 - RNA, 18 nt, artificial
  Chemically synthesized
accugugugacucuccau

SEQ ID NO: 5296 - RNA, 18 nt, artificial
  Chemically synthesized
cuaccuggaguggcccau

SEQ ID NO: 5297 - RNA, 18 nt, artificial
  Chemically synthesized
aaucacaguagaaaacag

SEQ ID NO: 5298 - RNA, 18 nt, artificial
  Chemically synthesized
aucaggcuucucugucuu

SEQ ID NO: 5299 - RNA, 18 nt, artificial
  Chemically synthesized
gcucaggaucuuuaaacu

SEQ ID NO: 5300 - RNA, 18 nt, artificial
  Chemically synthesized
ccagcgcuucugcaagcu

SEQ ID NO: 5301 - RNA, 18 nt, artificial
  Chemically synthesized
aacuuacugggaaauccu

SEQ ID NO: 5302 - RNA, 18 nt, artificial
  Chemically synthesized
aaagagccacaaaacugu

SEQ ID NO: 5303 - RNA, 18 nt, artificial
  Chemically synthesized
uugaaaaauucagccugu

SEQ ID NO: 5304 - RNA, 18 nt, artificial
  Chemically synthesized
auuagcaacagugaccua

SEQ ID NO: 5305 - RNA, 18 nt, artificial
  Chemically synthesized
aacugucuuugugcuuuc

SEQ ID NO: 5306 - RNA, 18 nt, artificial
  Chemically synthesized
ucuggcaugugcugugcu

SEQ ID NO: 5307 - RNA, 18 nt, artificial
  Chemically synthesized
caagcacuggccaaaguc

SEQ ID NO: 5308 - RNA, 18 nt, artificial
  Chemically synthesized
aacaccaagaccuaccug

SEQ ID NO: 5309 - RNA, 18 nt, artificial
  Chemically synthesized
caggaucaccuacauuag

SEQ ID NO: 5310 - RNA, 18 nt, artificial
  Chemically synthesized
uucagaauguaagucauc

SEQ ID NO: 5311 - RNA, 18 nt, artificial
  Chemically synthesized
cuccaucccaugugcgug

SEQ ID NO: 5312 - RNA, 18 nt, artificial
  Chemically synthesized
augacuguacccuuaaug

SEQ ID NO: 5313 - RNA, 18 nt, artificial
  Chemically synthesized
ucucccauuuccgucuuu

SEQ ID NO: 5314 - RNA, 18 nt, artificial
  Chemically synthesized
guccaacaacaggaucac

SEQ ID NO: 5315 - RNA, 18 nt, artificial
  Chemically synthesized
aaacuuacugggaaaucc

SEQ ID NO: 5316 - RNA, 18 nt, artificial
  Chemically synthesized
gcaagcacuggccaaagu

SEQ ID NO: 5317 - RNA, 18 nt, artificial
  Chemically synthesized
uuaacaauccggaggcug

SEQ ID NO: 5318 - RNA, 18 nt, artificial
  Chemically synthesized
aauguaagucaucugauc

SEQ ID NO: 5319 - RNA, 18 nt, artificial
  Chemically synthesized
ugcucuguuccugcugau

SEQ ID NO: 5320 - RNA, 18 nt, artificial
  Chemically synthesized
aagggcagcucaggaucu

SEQ ID NO: 5321 - RNA, 18 nt, artificial
  Chemically synthesized
cuuuuucuucccugggca

SEQ ID NO: 5322 - RNA, 18 nt, artificial
  Chemically synthesized
gaaaagauuuugcuggac

SEQ ID NO: 5323 - RNA, 18 nt, artificial
  Chemically synthesized
aaguaugaacuggacuuc

SEQ ID NO: 5324 - RNA, 18 nt, artificial
  Chemically synthesized
auccagcacacgaauaca

SEQ ID NO: 5325 - RNA, 18 nt, artificial
  Chemically synthesized
cacauacuuuguggaugg

SEQ ID NO: 5326 - RNA, 18 nt, artificial
  Chemically synthesized
cauuuccgucuuuuugau

SEQ ID NO: 5327 - RNA, 18 nt, artificial
  Chemically synthesized
cuuaccuuccuugaggaa

SEQ ID NO: 5328 - RNA, 18 nt, artificial
  Chemically synthesized
acuucucccauuuccguc

SEQ ID NO: 5329 - RNA, 18 nt, artificial
  Chemically synthesized
ccuguccaacaacaggau

SEQ ID NO: 5330 - RNA, 18 nt, artificial
  Chemically synthesized
guuauagauccagguaaa

SEQ ID NO: 5331 - RNA, 18 nt, artificial
  Chemically synthesized
uccugcugauccugcuca

SEQ ID NO: 5332 - RNA, 18 nt, artificial
  Chemically synthesized
uauagauccagguaaagu

SEQ ID NO: 5333 - RNA, 18 nt, artificial
  Chemically synthesized
ggaugccuacugggugga

SEQ ID NO: 5334 - RNA, 18 nt, artificial
  Chemically synthesized
aucccaugugcguggcca

SEQ ID NO: 5335 - RNA, 18 nt, artificial
  Chemically synthesized
agccugugaggaugccug

SEQ ID NO: 5336 - RNA, 18 nt, artificial
  Chemically synthesized
uccuccaaucaggcuucu

SEQ ID NO: 5337 - RNA, 18 nt, artificial
  Chemically synthesized
ugugacucuccaucccau

SEQ ID NO: 5338 - RNA, 18 nt, artificial
  Chemically synthesized
uuucagaacuauccacug

SEQ ID NO: 5339 - RNA, 18 nt, artificial
  Chemically synthesized
aaccuuaugguccaggag

SEQ ID NO: 5340 - RNA, 18 nt, artificial
  Chemically synthesized
aaauauggacaccuucac

SEQ ID NO: 5341 - RNA, 18 nt, artificial
  Chemically synthesized
cagcacacgaauacacag

SEQ ID NO: 5342 - RNA, 18 nt, artificial
  Chemically synthesized
cugauccuucauaugaag

SEQ ID NO: 5343 - RNA, 18 nt, artificial
  Chemically synthesized
uguuucuuacagugagcg

SEQ ID NO: 5344 - RNA, 18 nt, artificial
  Chemically synthesized
accuguccaacaacagga

SEQ ID NO: 5345 - RNA, 18 nt, artificial
  Chemically synthesized
gauuuugcuggacuuacc

SEQ ID NO: 5346 - RNA, 18 nt, artificial
  Chemically synthesized
uggugcugacauccaaug

SEQ ID NO: 5347 - RNA, 18 nt, artificial
  Chemically synthesized
uccuggcaaguggaucau

SEQ ID NO: 5348 - RNA, 18 nt, artificial
  Chemically synthesized
cuaccagaugccucccuc

SEQ ID NO: 5349 - RNA, 18 nt, artificial
  Chemically synthesized
ugcaaguaugaacuggac

SEQ ID NO: 5350 - RNA, 18 nt, artificial
  Chemically synthesized
aucagauuucuggauugu

SEQ ID NO: 5351 - RNA, 18 nt, artificial
  Chemically synthesized
cuggcuccaggccaaaag

SEQ ID NO: 5352 - RNA, 18 nt, artificial
  Chemically synthesized
auugauuggccagcaaau

SEQ ID NO: 5353 - RNA, 18 nt, artificial
  Chemically synthesized
auguaagucaucugaucc

SEQ ID NO: 5354 - RNA, 18 nt, artificial
  Chemically synthesized
cucuccaucccaugugcg

SEQ ID NO: 5355 - RNA, 18 nt, artificial
  Chemically synthesized
uauuuuacugcuggagau

SEQ ID NO: 5356 - RNA, 18 nt, artificial
  Chemically synthesized
cuucugcaagcugcggaa

SEQ ID NO: 5357 - RNA, 18 nt, artificial
  Chemically synthesized
gagaaccuuaugguccag

SEQ ID NO: 5358 - RNA, 18 nt, artificial
  Chemically synthesized
uaaacuuacugggaaauc

SEQ ID NO: 5359 - RNA, 18 nt, artificial
  Chemically synthesized
gugacucuccaucccaug

SEQ ID NO: 5360 - RNA, 18 nt, artificial
  Chemically synthesized
ugcugugcucuguuccug

SEQ ID NO: 5361 - RNA, 18 nt, artificial
  Chemically synthesized
auaagcgggacuucauuc

SEQ ID NO: 5362 - RNA, 18 nt, artificial
  Chemically synthesized
aaaugugaaaaucaccga

SEQ ID NO: 5363 - RNA, 18 nt, artificial
  Chemically synthesized
aaauuaccugugugacuc

SEQ ID NO: 5364 - RNA, 18 nt, artificial
  Chemically synthesized
uucuuacagugagcggga

SEQ ID NO: 5365 - RNA, 18 nt, artificial
  Chemically synthesized
acaaugaugcugccauuc

SEQ ID NO: 5366 - RNA, 18 nt, artificial
  Chemically synthesized
aucaucagccucuccaag

SEQ ID NO: 5367 - RNA, 18 nt, artificial
  Chemically synthesized
aaauucagccugugagga

SEQ ID NO: 5368 - RNA, 18 nt, artificial
  Chemically synthesized
acauuagcaacagugacc

SEQ ID NO: 5369 - RNA, 18 nt, artificial
  Chemically synthesized
agaauccuccaaucaggc

SEQ ID NO: 5370 - RNA, 18 nt, artificial
  Chemically synthesized
gauggugugggucuuggg

SEQ ID NO: 5371 - RNA, 18 nt, artificial
  Chemically synthesized
uuuccgucuuuuugauga

SEQ ID NO: 5372 - RNA, 18 nt, artificial
  Chemically synthesized
aauuugccgcaacucaaa

SEQ ID NO: 5373 - RNA, 18 nt, artificial
  Chemically synthesized
ugaacuuauccagcacac

SEQ ID NO: 5374 - RNA, 18 nt, artificial
  Chemically synthesized
uccaaucaggcuucucug

SEQ ID NO: 5375 - RNA, 18 nt, artificial
  Chemically synthesized
aaugugaaaaucaccgau

SEQ ID NO: 5376 - RNA, 18 nt, artificial
  Chemically synthesized
cccagcgcuucugcaagc

SEQ ID NO: 5377 - RNA, 18 nt, artificial
  Chemically synthesized
agcaagcacuggccaaag

SEQ ID NO: 5378 - RNA, 18 nt, artificial
  Chemically synthesized
ugugcugugcucuguucc

SEQ ID NO: 5379 - RNA, 18 nt, artificial
  Chemically synthesized
aacaaugaugcugccauu

SEQ ID NO: 5380 - RNA, 18 nt, artificial
  Chemically synthesized
ucauuccuggcaagugga

SEQ ID NO: 5381 - RNA, 18 nt, artificial
  Chemically synthesized
aauuaccugugugacucu

SEQ ID NO: 5382 - RNA, 18 nt, artificial
  Chemically synthesized
aguuugaugacuguaccc

SEQ ID NO: 5383 - RNA, 18 nt, artificial
  Chemically synthesized
uuuucagaacuauccacu

SEQ ID NO: 5384 - RNA, 18 nt, artificial
  Chemically synthesized
ucccucuuacccauguua

SEQ ID NO: 5385 - RNA, 18 nt, artificial
  Chemically synthesized
uggccagcaaauuaccug

SEQ ID NO: 5386 - RNA, 18 nt, artificial
  Chemically synthesized
caucucuuuuuucucauc

SEQ ID NO: 5387 - RNA, 18 nt, artificial
  Chemically synthesized
cagaugccucccucuuac

SEQ ID NO: 5388 - RNA, 18 nt, artificial
  Chemically synthesized
ugaagcagcauauuuuac

SEQ ID NO: 5389 - RNA, 18 nt, artificial
  Chemically synthesized
uaccugugugacucucca

SEQ ID NO: 5390 - RNA, 18 nt, artificial
  Chemically synthesized
uuuacugcuggagauuuu

SEQ ID NO: 5391 - RNA, 18 nt, artificial
  Chemically synthesized
uucaggauguccgccucu

SEQ ID NO: 5392 - RNA, 18 nt, artificial
  Chemically synthesized
uucacucaggagcagcaa

SEQ ID NO: 5393 - RNA, 18 nt, artificial
  Chemically synthesized
auccagguaaaguggaaa

SEQ ID NO: 5394 - RNA, 18 nt, artificial
  Chemically synthesized
gucuggcaugugcugugc

SEQ ID NO: 5395 - RNA, 18 nt, artificial
  Chemically synthesized
aucuuuaaacuccauucc

SEQ ID NO: 5396 - RNA, 18 nt, artificial
  Chemically synthesized
uggauggugugggucuug

SEQ ID NO: 5397 - RNA, 18 nt, artificial
  Chemically synthesized
cugugcucuguuccugcu

SEQ ID NO: 5398 - RNA, 18 nt, artificial
  Chemically synthesized
aauccggaggcugcauau

SEQ ID NO: 5399 - RNA, 18 nt, artificial
  Chemically synthesized
gugagcgggaugccuacu

SEQ ID NO: 5400 - RNA, 18 nt, artificial
  Chemically synthesized
uuacugcuggagauuuuu

SEQ ID NO: 5401 - RNA, 18 nt, artificial
  Chemically synthesized
uucagaacuauccacugg

SEQ ID NO: 5402 - RNA, 18 nt, artificial
  Chemically synthesized
ugaccuguccaacaacag

SEQ ID NO: 5403 - RNA, 18 nt, artificial
  Chemically synthesized
guuccugcugauccugcu

SEQ ID NO: 5404 - RNA, 18 nt, artificial
  Chemically synthesized
ccuaccuggaguggccca

SEQ ID NO: 5405 - RNA, 18 nt, artificial
  Chemically synthesized
uugaacuuauccagcaca

SEQ ID NO: 5406 - RNA, 18 nt, artificial
  Chemically synthesized
aggaucuuuaaacuccau

SEQ ID NO: 5407 - RNA, 18 nt, artificial
  Chemically synthesized
auacacaguguaacaggc

SEQ ID NO: 5408 - RNA, 18 nt, artificial
  Chemically synthesized
uaccuuccuugaggaacu

SEQ ID NO: 5409 - RNA, 18 nt, artificial
  Chemically synthesized
ugccacauacuuugugga

SEQ ID NO: 5410 - RNA, 18 nt, artificial
  Chemically synthesized
ucaggagcagcaagcacu

SEQ ID NO: 5411 - RNA, 18 nt, artificial
  Chemically synthesized
uugugcuuucugaaaacu

SEQ ID NO: 5412 - RNA, 18 nt, artificial
  Chemically synthesized
cuuaugguccaggagcug

SEQ ID NO: 5413 - RNA, 18 nt, artificial
  Chemically synthesized
guucaggauguccgccuc

SEQ ID NO: 5414 - RNA, 18 nt, artificial
  Chemically synthesized
ucaggauguccgccucuc

SEQ ID NO: 5415 - RNA, 18 nt, artificial
  Chemically synthesized
uuugcuggacuuaccuuc

SEQ ID NO: 5416 - RNA, 18 nt, artificial
  Chemically synthesized
gaaauccuuacaaaaccc

SEQ ID NO: 5417 - RNA, 18 nt, artificial
  Chemically synthesized
uugugucuucauaagcgg

SEQ ID NO: 5418 - RNA, 18 nt, artificial
  Chemically synthesized
acaguaaaguuuuucugg

SEQ ID NO: 5419 - RNA, 18 nt, artificial
  Chemically synthesized
caagaccuaccuggagug

SEQ ID NO: 5420 - RNA, 18 nt, artificial
  Chemically synthesized
ugucuucauaagcgggac

SEQ ID NO: 5421 - RNA, 18 nt, artificial
  Chemically synthesized
uuauccagcacacgaaua

SEQ ID NO: 5422 - RNA, 18 nt, artificial
  Chemically synthesized
aucuacagagcuaugagc

SEQ ID NO: 5423 - RNA, 18 nt, artificial
  Chemically synthesized
ucuccaucccaugugcgu

SEQ ID NO: 5424 - RNA, 18 nt, artificial
  Chemically synthesized
ucuuacccauguuacuag

SEQ ID NO: 5425 - RNA, 18 nt, artificial
  Chemically synthesized
uuuugcuggacuuaccuu

SEQ ID NO: 5426 - RNA, 18 nt, artificial
  Chemically synthesized
uugccgcaacucaaagaa

SEQ ID NO: 5427 - RNA, 18 nt, artificial
  Chemically synthesized
uucucccauuuccgucuu

SEQ ID NO: 5428 - RNA, 18 nt, artificial
  Chemically synthesized
ugucuggcaugugcugug

SEQ ID NO: 5429 - RNA, 18 nt, artificial
  Chemically synthesized
ucuaaggagcaacuugac

SEQ ID NO: 5430 - RNA, 18 nt, artificial
  Chemically synthesized
ugaaaaugaugugggccu

SEQ ID NO: 5431 - RNA, 18 nt, artificial
  Chemically synthesized
uuggguaaaucugagagc

SEQ ID NO: 5432 - RNA, 18 nt, artificial
  Chemically synthesized
ucuaccagaugccucccu

SEQ ID NO: 5433 - RNA, 18 nt, artificial
  Chemically synthesized
aaggaagcccaggaaagc

SEQ ID NO: 5434 - RNA, 18 nt, artificial
  Chemically synthesized
uacugcuggagauuuuug

SEQ ID NO: 5435 - RNA, 18 nt, artificial
  Chemically synthesized
uguuccugcugauccugc

SEQ ID NO: 5436 - RNA, 18 nt, artificial
  Chemically synthesized
accuuccuugaggaacuu

SEQ ID NO: 5437 - RNA, 18 nt, artificial
  Chemically synthesized
aagaauccuccaaucagg

SEQ ID NO: 5438 - RNA, 18 nt, artificial
  Chemically synthesized
acucaggagcagcaagca

SEQ ID NO: 5439 - RNA, 18 nt, artificial
  Chemically synthesized
ugacucuccaucccaugu

SEQ ID NO: 5440 - RNA, 18 nt, artificial
  Chemically synthesized
aagcugguggcaauaacu

SEQ ID NO: 5441 - RNA, 18 nt, artificial
  Chemically synthesized
agguucaggauguccgcc

SEQ ID NO: 5442 - RNA, 18 nt, artificial
  Chemically synthesized
aaaaagccuugaccuguc

SEQ ID NO: 5443 - RNA, 18 nt, artificial
  Chemically synthesized
uuggaacugcgagauacu

SEQ ID NO: 5444 - RNA, 18 nt, artificial
  Chemically synthesized
uguaacaggcugcauucc

SEQ ID NO: 5445 - RNA, 18 nt, artificial
  Chemically synthesized
aacagugaccuacagagg

SEQ ID NO: 5446 - RNA, 18 nt, artificial
  Chemically synthesized
auucagccugugaggaug

SEQ ID NO: 5447 - RNA, 18 nt, artificial
  Chemically synthesized
acauacuuuguggauggu

SEQ ID NO: 5448 - RNA, 18 nt, artificial
  Chemically synthesized
ugccucccucuuacccau

SEQ ID NO: 5449 - RNA, 18 nt, artificial
  Chemically synthesized
aucaccgaugaaaguuug

SEQ ID NO: 5450 - RNA, 18 nt, artificial
  Chemically synthesized
gcgcuucugcaagcugcg

SEQ ID NO: 5451 - RNA, 18 nt, artificial
  Chemically synthesized
ucaggcuucucugucuug

SEQ ID NO: 5452 - RNA, 18 nt, artificial
  Chemically synthesized
gagcgggaugccuacugg

SEQ ID NO: 5453 - RNA, 18 nt, artificial
  Chemically synthesized
augugcugugcucuguuc

SEQ ID NO: 5454 - RNA, 18 nt, artificial
  Chemically synthesized
uaacuucauuugcuccug

SEQ ID NO: 5455 - RNA, 18 nt, artificial
  Chemically synthesized
uuugcuccugugaauucc

SEQ ID NO: 5456 - RNA, 18 nt, artificial
  Chemically synthesized
gaagcccaggaaagcucc

SEQ ID NO: 5457 - RNA, 18 nt, artificial
  Chemically synthesized
uguacccuuaauggaguu

SEQ ID NO: 5458 - RNA, 18 nt, artificial
  Chemically synthesized
uugcuccugugaauuccu

SEQ ID NO: 5459 - RNA, 18 nt, artificial
  Chemically synthesized
uaugaacuggacuucucc

SEQ ID NO: 5460 - RNA, 18 nt, artificial
  Chemically synthesized
uuguggaugguguggguc

SEQ ID NO: 5461 - RNA, 18 nt, artificial
  Chemically synthesized
cuucucugucuugugacc

SEQ ID NO: 5462 - RNA, 18 nt, artificial
  Chemically synthesized
auuuugcuggacuuaccu

SEQ ID NO: 5463 - RNA, 18 nt, artificial
  Chemically synthesized
auagauccagguaaagug

SEQ ID NO: 5464 - RNA, 18 nt, artificial
  Chemically synthesized
uaccagaugccucccucu

SEQ ID NO: 5465 - RNA, 18 nt, artificial
  Chemically synthesized
gaccuaccuggaguggcc

SEQ ID NO: 5466 - RNA, 18 nt, artificial
  Chemically synthesized
uaugccugaaacuuguca

SEQ ID NO: 5467 - RNA, 18 nt, artificial
  Chemically synthesized
cuguuccugcugauccug

SEQ ID NO: 5468 - RNA, 18 nt, artificial
  Chemically synthesized
gaugugggccuggcucca

SEQ ID NO: 5469 - RNA, 18 nt, artificial
  Chemically synthesized
uacaaguuccguggaaug

SEQ ID NO: 5470 - RNA, 18 nt, artificial
  Chemically synthesized
gccugugaggaugccugg

SEQ ID NO: 5471 - RNA, 18 nt, artificial
  Chemically synthesized
auccuccaaucaggcuuc

SEQ ID NO: 5472 - RNA, 18 nt, artificial
  Chemically synthesized
uacuugaaaaauucagcc

SEQ ID NO: 5473 - RNA, 18 nt, artificial
  Chemically synthesized
cugugaggaugccuggcc

SEQ ID NO: 5474 - RNA, 18 nt, artificial
  Chemically synthesized
ccaucccaugugcguggc

SEQ ID NO: 5475 - RNA, 18 nt, artificial
  Chemically synthesized
aacaauccggaggcugca

SEQ ID NO: 5476 - RNA, 18 nt, artificial
  Chemically synthesized
uucugguuccuuguuuac

SEQ ID NO: 5477 - RNA, 18 nt, artificial
  Chemically synthesized
agcgggaugccuacuggg

SEQ ID NO: 5478 - RNA, 18 nt, artificial
  Chemically synthesized
auuaccugugugacucuc

SEQ ID NO: 5479 - RNA, 18 nt, artificial
  Chemically synthesized
aagagccacaaaacuguc

SEQ ID NO: 5480 - RNA, 18 nt, artificial
  Chemically synthesized
uaaaucugagagcugcga

SEQ ID NO: 5481 - RNA, 18 nt, artificial
  Chemically synthesized
uuuggguaaaucugagag

SEQ ID NO: 5482 - RNA, 18 nt, artificial
  Chemically synthesized
aaugccacauacuuugug

SEQ ID NO: 5483 - RNA, 18 nt, artificial
  Chemically synthesized
uaacacaauagaggaaga

SEQ ID NO: 5484 - RNA, 18 nt, artificial
  Chemically synthesized
ugagcgggaugccuacug

SEQ ID NO: 5485 - RNA, 18 nt, artificial
  Chemically synthesized
uugaccuguccaacaaca

SEQ ID NO: 5486 - RNA, 18 nt, artificial
  Chemically synthesized
augaugugggccuggcuc

SEQ ID NO: 5487 - RNA, 18 nt, artificial
  Chemically synthesized
ccaggccaaaaggaagcc

SEQ ID NO: 5488 - RNA, 18 nt, artificial
  Chemically synthesized
uuugugcuuucugaaaac

SEQ ID NO: 5489 - RNA, 18 nt, artificial
  Chemically synthesized
aaaaucaccgaugaaagu

SEQ ID NO: 5490 - RNA, 18 nt, artificial
  Chemically synthesized
uaaacuccauucccucag

SEQ ID NO: 5491 - RNA, 18 nt, artificial
  Chemically synthesized
ucaccgaugaaaguuugu

SEQ ID NO: 5492 - RNA, 18 nt, artificial
  Chemically synthesized
uuugaauuugccgcaacu

SEQ ID NO: 5493 - RNA, 18 nt, artificial
  Chemically synthesized
ucacucaggagcagcaag

SEQ ID NO: 5494 - RNA, 18 nt, artificial
  Chemically synthesized
aagaccuaccuggagugg

SEQ ID NO: 5495 - RNA, 18 nt, artificial
  Chemically synthesized
cucuaccagaugccuccc

SEQ ID NO: 5496 - RNA, 18 nt, artificial
  Chemically synthesized
agugagcgggaugccuac

SEQ ID NO: 5497 - RNA, 18 nt, artificial
  Chemically synthesized
acuuuguggauggugugg

SEQ ID NO: 5498 - RNA, 18 nt, artificial
  Chemically synthesized
ccugugaggaugccuggc

SEQ ID NO: 5499 - RNA, 18 nt, artificial
  Chemically synthesized
augacucuaccagaugcc

SEQ ID NO: 5500 - RNA, 18 nt, artificial
  Chemically synthesized
uaagcgggacuucauucc

SEQ ID NO: 5501 - RNA, 18 nt, artificial
  Chemically synthesized
uaccuggaguggcccaug

SEQ ID NO: 5502 - RNA, 18 nt, artificial
  Chemically synthesized
uuuuggguaaaucugaga

SEQ ID NO: 5503 - RNA, 18 nt, artificial
  Chemically synthesized
aggagcagcaagcacugg

SEQ ID NO: 5504 - RNA, 18 nt, artificial
  Chemically synthesized
acucuaccagaugccucc

SEQ ID NO: 5505 - RNA, 18 nt, artificial
  Chemically synthesized
uuccuggcaaguggauca

SEQ ID NO: 5506 - RNA, 18 nt, artificial
  Chemically synthesized
uacuuuguggauggugug

SEQ ID NO: 5507 - RNA, 18 nt, artificial
  Chemically synthesized
caggagcagcaagcacug

SEQ ID NO: 5508 - RNA, 18 nt, artificial
  Chemically synthesized
uaugguccaggagcugga

SEQ ID NO: 5509 - RNA, 18 nt, artificial
  Chemically synthesized
aaaguuuuucugguuccu

SEQ ID NO: 5510 - RNA, 18 nt, artificial
  Chemically synthesized
uuguuucuuacagugagc

SEQ ID NO: 5511 - RNA, 18 nt, artificial
  Chemically synthesized
uuuuucugguuccuuguu

SEQ ID NO: 5512 - RNA, 18 nt, artificial
  Chemically synthesized
uccuucacucaggagcag

SEQ ID NO: 5513 - RNA, 18 nt, artificial
  Chemically synthesized
gaaaaugaugugggccug

SEQ ID NO: 5514 - RNA, 18 nt, artificial
  Chemically synthesized
uugcuggacuuaccuucc

SEQ ID NO: 5515 - RNA, 18 nt, artificial
  Chemically synthesized
ucuguuccugcugauccu

SEQ ID NO: 5516 - RNA, 18 nt, artificial
  Chemically synthesized
augugggccuggcuccag

SEQ ID NO: 5517 - RNA, 18 nt, artificial
  Chemically synthesized
agaugccucccucuuacc

SEQ ID NO: 5518 - RNA, 18 nt, artificial
  Chemically synthesized
gugaggaugccuggcccu

SEQ ID NO: 5519 - RNA, 18 nt, artificial
  Chemically synthesized
acucuccaucccaugugc

SEQ ID NO: 5520 - RNA, 18 nt, artificial
  Chemically synthesized
uuugugaagagugagugg

SEQ ID NO: 5521 - RNA, 18 nt, artificial
  Chemically synthesized
aagcagcauauuuuacug

SEQ ID NO: 5522 - RNA, 18 nt, artificial
  Chemically synthesized
uccaacaacaggaucacc

SEQ ID NO: 5523 - RNA, 18 nt, artificial
  Chemically synthesized
uacagugagcgggaugcc

SEQ ID NO: 5524 - RNA, 18 nt, artificial
  Chemically synthesized
aauaacuucauuugcucc

SEQ ID NO: 5525 - RNA, 18 nt, artificial
  Chemically synthesized
uuuuucagaacuauccac

SEQ ID NO: 5526 - RNA, 18 nt, artificial
  Chemically synthesized
aaugaugugggccuggcu

SEQ ID NO: 5527 - RNA, 18 nt, artificial
  Chemically synthesized
aaaugaugugggccuggc

SEQ ID NO: 5528 - RNA, 18 nt, artificial
  Chemically synthesized
uuuucuuugaauuugccg

SEQ ID NO: 5529 - RNA, 18 nt, artificial
  Chemically synthesized
augaaaaugaugugggcc

SEQ ID NO: 5530 - RNA, 18 nt, artificial
  Chemically synthesized
uuacagugagcgggaugc

SEQ ID NO: 5531 - RNA, 18 nt, artificial
  Chemically synthesized
uucuuuuucuucccuggg

SEQ ID NO: 5532 - RNA, 18 nt, artificial
  Chemically synthesized
auucuuuuucuucccugg

SEQ ID NO: 5533 - RNA, 18 nt, artificial
  Chemically synthesized
aagauucuuuuucuuccc

SEQ ID NO: 5534 - RNA, 18 nt, artificial
  Chemically synthesized
uccagguaaaguggaaac

SEQ ID NO: 5535 - RNA, 18 nt, artificial
  Chemically synthesized
uccaucccaugugcgugg

SEQ ID NO: 5536 - RNA, 18 nt, artificial
  Chemically synthesized
uuggccagcaaauuaccu

SEQ ID NO: 5537 - RNA, 18 nt, artificial
  Chemically synthesized
uuaaacuccauucccuca

SEQ ID NO: 5538 - RNA, 18 nt, artificial
  Chemically synthesized
aggaugccuggcccucuc

SEQ ID NO: 5539 - RNA, 18 nt, artificial
  Chemically synthesized
uaugaaaaugaugugggc

SEQ ID NO: 5540 - RNA, 18 nt, artificial
  Chemically synthesized
aaaaugaugugggccugg

SEQ ID NO: 5541 - RNA, 18 nt, artificial
  Chemically synthesized
ugaggaugccuggcccuc

SEQ ID NO: 5542 - RNA, 18 nt, artificial
  Chemically synthesized
uaaaguuuuucugguucc

SEQ ID NO: 5543 - RNA, 18 nt, artificial
  Chemically synthesized
uuauagauccagguaaag

SEQ ID NO: 5544 - RNA, 18 nt, artificial
  Chemically synthesized
ucccaugugcguggccag

SEQ ID NO: 5545 - RNA, 18 nt, artificial
  Chemically synthesized
ugugaggaugccuggccc

SEQ ID NO: 5546 - RNA, 18 nt, artificial
  Chemically synthesized
uuuguggauggugugggu

SEQ ID NO: 5547 - RNA, 18 nt, artificial
  Chemically synthesized
ugugggccuggcuccagg

SEQ ID NO: 5548 - RNA, 18 nt, artificial
  Chemically synthesized
auuggccagcaaauuacc

SEQ ID NO: 5549 - RNA, 18 nt, artificial
  Chemically synthesized
uccaggccaaaaggaagc

SEQ ID NO: 5550 - RNA, 18 nt, artificial
  Chemically synthesized
uucagccugugaggaugc

SEQ ID NO: 5551 - RNA, 18 nt, artificial
  Chemically synthesized
ucagccugugaggaugcc

SEQ ID NO: 5552 - RNA, 18 nt, artificial
  Chemically synthesized
gugggccuggcuccaggc

SEQ ID NO: 5553 - RNA, 18 nt, artificial
  Chemically synthesized
uuuuucuucccugggcag

SEQ ID NO: 5554 - RNA, 18 nt, artificial
  Chemically synthesized
gguaggucuugguguuca

SEQ ID NO: 5555 - RNA, 18 nt, artificial
  Chemically synthesized
cauggguaagagggaggc

SEQ ID NO: 5556 - RNA, 18 nt, artificial
  Chemically synthesized
uccagcaaaaucuuuucu

SEQ ID NO: 5557 - RNA, 18 nt, artificial
  Chemically synthesized
uccugagcugcccuugca

SEQ ID NO: 5558 - RNA, 18 nt, artificial
  Chemically synthesized
gcucuuuucaauggaguc

SEQ ID NO: 5559 - RNA, 18 nt, artificial
  Chemically synthesized
cuuuacuguuuucuacug

SEQ ID NO: 5560 - RNA, 18 nt, artificial
  Chemically synthesized
ugggagaaguccaguuca

SEQ ID NO: 5561 - RNA, 18 nt, artificial
  Chemically synthesized
cugcuucauaugaaggau

SEQ ID NO: 5562 - RNA, 18 nt, artificial
  Chemically synthesized
cuuccuuuuggccuggag

SEQ ID NO: 5563 - RNA, 18 nt, artificial
  Chemically synthesized
aguuuguagagagggcca

SEQ ID NO: 5564 - RNA, 18 nt, artificial
  Chemically synthesized
agggaagaaaaagaaucu

SEQ ID NO: 5565 - RNA, 18 nt, artificial
  Chemically synthesized
aggagcaaaugaaguuau

SEQ ID NO: 5566 - RNA, 18 nt, artificial
  Chemically synthesized
gaaccagaaaaacuuuac

SEQ ID NO: 5567 - RNA, 18 nt, artificial
  Chemically synthesized
accagcuuccaaagucuu

SEQ ID NO: 5568 - RNA, 18 nt, artificial
  Chemically synthesized
gcaguaaaauaugcugcu

SEQ ID NO: 5569 - RNA, 18 nt, artificial
  Chemically synthesized
ugguagagucaucaacuu

SEQ ID NO: 5570 - RNA, 18 nt, artificial
  Chemically synthesized
aacuuucaucggugauuu

SEQ ID NO: 5571 - RNA, 18 nt, artificial
  Chemically synthesized
ugggagcuuuccugggcu

SEQ ID NO: 5572 - RNA, 18 nt, artificial
  Chemically synthesized
aggcaucugguagaguca

SEQ ID NO: 5573 - RNA, 18 nt, artificial
  Chemically synthesized
caauuuugugagaugaga

SEQ ID NO: 5574 - RNA, 18 nt, artificial
  Chemically synthesized
aaacauuccacggaacuu

SEQ ID NO: 5575 - RNA, 18 nt, artificial
  Chemically synthesized
guaggucuugguguucau

SEQ ID NO: 5576 - RNA, 18 nt, artificial
  Chemically synthesized
agucccgcuuaugaagac

SEQ ID NO: 5577 - RNA, 18 nt, artificial
  Chemically synthesized
aaaaagacggaaauggga

SEQ ID NO: 5578 - RNA, 18 nt, artificial
  Chemically synthesized
uaaacaaggaaccagaaa

SEQ ID NO: 5579 - RNA, 18 nt, artificial
  Chemically synthesized
cucuuuucaauggaguca

SEQ ID NO: 5580 - RNA, 18 nt, artificial
  Chemically synthesized
uuagugaagguguccaua

SEQ ID NO: 5581 - RNA, 18 nt, artificial
  Chemically synthesized
ggauggagagucacacag

SEQ ID NO: 5582 - RNA, 18 nt, artificial
  Chemically synthesized
aucuuccucuauuguguu

SEQ ID NO: 5583 - RNA, 18 nt, artificial
  Chemically synthesized
ggauucuuccuuggagag

SEQ ID NO: 5584 - RNA, 18 nt, artificial
  Chemically synthesized
cuuaugaagacacaacuu

SEQ ID NO: 5585 - RNA, 18 nt, artificial
  Chemically synthesized
acaggagcaaaugaaguu

SEQ ID NO: 5586 - RNA, 18 nt, artificial
  Chemically synthesized
aucugguagagucaucaa

SEQ ID NO: 5587 - RNA, 18 nt, artificial
  Chemically synthesized
aucccgcucacuguaaga

SEQ ID NO: 5588 - RNA, 18 nt, artificial
  Chemically synthesized
auggagagucacacaggu

SEQ ID NO: 5589 - RNA, 18 nt, artificial
  Chemically synthesized
augggccacuccagguag

SEQ ID NO: 5590 - RNA, 18 nt, artificial
  Chemically synthesized
cuguuuucuacugugauu

SEQ ID NO: 5591 - RNA, 18 nt, artificial
  Chemically synthesized
aagacagagaagccugau

SEQ ID NO: 5592 - RNA, 18 nt, artificial
  Chemically synthesized
aguuuaaagauccugagc

SEQ ID NO: 5593 - RNA, 18 nt, artificial
  Chemically synthesized
agcuugcagaagcgcugg

SEQ ID NO: 5594 - RNA, 18 nt, artificial
  Chemically synthesized
aggauuucccaguaaguu

SEQ ID NO: 5595 - RNA, 18 nt, artificial
  Chemically synthesized
acaguuuuguggcucuuu

SEQ ID NO: 5596 - RNA, 18 nt, artificial
  Chemically synthesized
acaggcugaauuuuucaa

SEQ ID NO: 5597 - RNA, 18 nt, artificial
  Chemically synthesized
uaggucacuguugcuaau

SEQ ID NO: 5598 - RNA, 18 nt, artificial
  Chemically synthesized
gaaagcacaaagacaguu

SEQ ID NO: 5599 - RNA, 18 nt, artificial
  Chemically synthesized
agcacagcacaugccaga

SEQ ID NO: 5600 - RNA, 18 nt, artificial
  Chemically synthesized
gacuuuggccagugcuug

SEQ ID NO: 5601 - RNA, 18 nt, artificial
  Chemically synthesized
cagguaggucuugguguu

SEQ ID NO: 5602 - RNA, 18 nt, artificial
  Chemically synthesized
cuaauguaggugauccug

SEQ ID NO: 5603 - RNA, 18 nt, artificial
  Chemically synthesized
gaugacuuacauucugaa

SEQ ID NO: 5604 - RNA, 18 nt, artificial
  Chemically synthesized
cacgcacaugggauggag

SEQ ID NO: 5605 - RNA, 18 nt, artificial
  Chemically synthesized
cauuaaggguacagucau

SEQ ID NO: 5606 - RNA, 18 nt, artificial
  Chemically synthesized
aaagacggaaaugggaga

SEQ ID NO: 5607 - RNA, 18 nt, artificial
  Chemically synthesized
gugauccuguuguuggac

SEQ ID NO: 5608 - RNA, 18 nt, artificial
  Chemically synthesized
ggauuucccaguaaguuu

SEQ ID NO: 5609 - RNA, 18 nt, artificial
  Chemically synthesized
acuuuggccagugcuugc

SEQ ID NO: 5610 - RNA, 18 nt, artificial
  Chemically synthesized
cagccuccggauuguuaa

SEQ ID NO: 5611 - RNA, 18 nt, artificial
  Chemically synthesized
gaucagaugacuuacauu

SEQ ID NO: 5612 - RNA, 18 nt, artificial
  Chemically synthesized
aucagcaggaacagagca

SEQ ID NO: 5613 - RNA, 18 nt, artificial
  Chemically synthesized
agauccugagcugcccuu

SEQ ID NO: 5614 - RNA, 18 nt, artificial
  Chemically synthesized
ugcccagggaagaaaaag

SEQ ID NO: 5615 - RNA, 18 nt, artificial
  Chemically synthesized
guccagcaaaaucuuuuc

SEQ ID NO: 5616 - RNA, 18 nt, artificial
  Chemically synthesized
gaaguccaguucauacuu

SEQ ID NO: 5617 - RNA, 18 nt, artificial
  Chemically synthesized
uguauucgugugcuggau

SEQ ID NO: 5618 - RNA, 18 nt, artificial
  Chemically synthesized
ccauccacaaaguaugug

SEQ ID NO: 5619 - RNA, 18 nt, artificial
  Chemically synthesized
aucaaaaagacggaaaug

SEQ ID NO: 5620 - RNA, 18 nt, artificial
  Chemically synthesized
uuccucaaggaagguaag

SEQ ID NO: 5621 - RNA, 18 nt, artificial
  Chemically synthesized
gacggaaaugggagaagu

SEQ ID NO: 5622 - RNA, 18 nt, artificial
  Chemically synthesized
auccuguuguuggacagg

SEQ ID NO: 5623 - RNA, 18 nt, artificial
  Chemically synthesized
uuuaccuggaucuauaac

SEQ ID NO: 5624 - RNA, 18 nt, artificial
  Chemically synthesized
ugagcaggaucagcagga

SEQ ID NO: 5625 - RNA, 18 nt, artificial
  Chemically synthesized
acuuuaccuggaucuaua

SEQ ID NO: 5626 - RNA, 18 nt, artificial
  Chemically synthesized
uccacccaguaggcaucc

SEQ ID NO: 5627 - RNA, 18 nt, artificial
  Chemically synthesized
uggccacgcacaugggau

SEQ ID NO: 5628 - RNA, 18 nt, artificial
  Chemically synthesized
caggcauccucacaggcu

SEQ ID NO: 5629 - RNA, 18 nt, artificial
  Chemically synthesized
agaagccugauuggagga

SEQ ID NO: 5630 - RNA, 18 nt, artificial
  Chemically synthesized
augggauggagagucaca

SEQ ID NO: 5631 - RNA, 18 nt, artificial
  Chemically synthesized
caguggauaguucugaaa

SEQ ID NO: 5632 - RNA, 18 nt, artificial
  Chemically synthesized
cuccuggaccauaagguu

SEQ ID NO: 5633 - RNA, 18 nt, artificial
  Chemically synthesized
gugaagguguccauauuu

SEQ ID NO: 5634 - RNA, 18 nt, artificial
  Chemically synthesized
cuguguauucgugugcug

SEQ ID NO: 5635 - RNA, 18 nt, artificial
  Chemically synthesized
cuucauaugaaggaucag

SEQ ID NO: 5636 - RNA, 18 nt, artificial
  Chemically synthesized
cgcucacuguaagaaaca

SEQ ID NO: 5637 - RNA, 18 nt, artificial
  Chemically synthesized
uccuguuguuggacaggu

SEQ ID NO: 5638 - RNA, 18 nt, artificial
  Chemically synthesized
gguaaguccagcaaaauc

SEQ ID NO: 5639 - RNA, 18 nt, artificial
  Chemically synthesized
cauuggaugucagcacca

SEQ ID NO: 5640 - RNA, 18 nt, artificial
  Chemically synthesized
augauccacuugccagga

SEQ ID NO: 5641 - RNA, 18 nt, artificial
  Chemically synthesized
gagggaggcaucugguag

SEQ ID NO: 5642 - RNA, 18 nt, artificial
  Chemically synthesized
guccaguucauacuugca

SEQ ID NO: 5643 - RNA, 18 nt, artificial
  Chemically synthesized
acaauccagaaaucugau

SEQ ID NO: 5644 - RNA, 18 nt, artificial
  Chemically synthesized
cuuuuggccuggagccag

SEQ ID NO: 5645 - RNA, 18 nt, artificial
  Chemically synthesized
auuugcuggccaaucaau

SEQ ID NO: 5646 - RNA, 18 nt, artificial
  Chemically synthesized
ggaucagaugacuuacau

SEQ ID NO: 5647 - RNA, 18 nt, artificial
  Chemically synthesized
cgcacaugggauggagag

SEQ ID NO: 5648 - RNA, 18 nt, artificial
  Chemically synthesized
aucuccagcaguaaaaua

SEQ ID NO: 5649 - RNA, 18 nt, artificial
  Chemically synthesized
uuccgcagcuugcagaag

SEQ ID NO: 5650 - RNA, 18 nt, artificial
  Chemically synthesized
cuggaccauaagguucuc

SEQ ID NO: 5651 - RNA, 18 nt, artificial
  Chemically synthesized
gauuucccaguaaguuua

SEQ ID NO: 5652 - RNA, 18 nt, artificial
  Chemically synthesized
caugggauggagagucac

SEQ ID NO: 5653 - RNA, 18 nt, artificial
  Chemically synthesized
caggaacagagcacagca

SEQ ID NO: 5654 - RNA, 18 nt, artificial
  Chemically synthesized
gaaugaagucccgcuuau

SEQ ID NO: 5655 - RNA, 18 nt, artificial
  Chemically synthesized
ucggugauuuucacauuu

SEQ ID NO: 5656 - RNA, 18 nt, artificial
  Chemically synthesized
gagucacacagguaauuu

SEQ ID NO: 5657 - RNA, 18 nt, artificial
  Chemically synthesized
ucccgcucacuguaagaa

SEQ ID NO: 5658 - RNA, 18 nt, artificial
  Chemically synthesized
gaauggcagcaucauugu

SEQ ID NO: 5659 - RNA, 18 nt, artificial
  Chemically synthesized
cuuggagaggcugaugau

SEQ ID NO: 5660 - RNA, 18 nt, artificial
  Chemically synthesized
uccucacaggcugaauuu

SEQ ID NO: 5661 - RNA, 18 nt, artificial
  Chemically synthesized
ggucacuguugcuaaugu

SEQ ID NO: 5662 - RNA, 18 nt, artificial
  Chemically synthesized
gccugauuggaggauucu

SEQ ID NO: 5663 - RNA, 18 nt, artificial
  Chemically synthesized
cccaagacccacaccauc

SEQ ID NO: 5664 - RNA, 18 nt, artificial
  Chemically synthesized
ucaucaaaaagacggaaa

SEQ ID NO: 5665 - RNA, 18 nt, artificial
  Chemically synthesized
uuugaguugcggcaaauu

SEQ ID NO: 5666 - RNA, 18 nt, artificial
  Chemically synthesized
gugugcuggauaaguuca

SEQ ID NO: 5667 - RNA, 18 nt, artificial
  Chemically synthesized
cagagaagccugauugga

SEQ ID NO: 5668 - RNA, 18 nt, artificial
  Chemically synthesized
aucggugauuuucacauu

SEQ ID NO: 5669 - RNA, 18 nt, artificial
  Chemically synthesized
gcuugcagaagcgcuggg

SEQ ID NO: 5670 - RNA, 18 nt, artificial
  Chemically synthesized
cuuuggccagugcuugcu

SEQ ID NO: 5671 - RNA, 18 nt, artificial
  Chemically synthesized
ggaacagagcacagcaca

SEQ ID NO: 5672 - RNA, 18 nt, artificial
  Chemically synthesized
aauggcagcaucauuguu

SEQ ID NO: 5673 - RNA, 18 nt, artificial
  Chemically synthesized
uccacuugccaggaauga

SEQ ID NO: 5674 - RNA, 18 nt, artificial
  Chemically synthesized
agagucacacagguaauu

SEQ ID NO: 5675 - RNA, 18 nt, artificial
  Chemically synthesized
ggguacagucaucaaacu

SEQ ID NO: 5676 - RNA, 18 nt, artificial
  Chemically synthesized
aguggauaguucugaaaa

SEQ ID NO: 5677 - RNA, 18 nt, artificial
  Chemically synthesized
uaacauggguaagaggga

SEQ ID NO: 5678 - RNA, 18 nt, artificial
  Chemically synthesized
cagguaauuugcuggcca

SEQ ID NO: 5679 - RNA, 18 nt, artificial
  Chemically synthesized
gaugagaaaaaagagaug

SEQ ID NO: 5680 - RNA, 18 nt, artificial
  Chemically synthesized
guaagagggaggcaucug

SEQ ID NO: 5681 - RNA, 18 nt, artificial
  Chemically synthesized
guaaaauaugcugcuuca

SEQ ID NO: 5682 - RNA, 18 nt, artificial
  Chemically synthesized
uggagagucacacaggua

SEQ ID NO: 5683 - RNA, 18 nt, artificial
  Chemically synthesized
aaaaucuccagcaguaaa

SEQ ID NO: 5684 - RNA, 18 nt, artificial
  Chemically synthesized
agaggcggacauccugaa

SEQ ID NO: 5685 - RNA, 18 nt, artificial
  Chemically synthesized
uugcugcuccugagugaa

SEQ ID NO: 5686 - RNA, 18 nt, artificial
  Chemically synthesized
uuuccacuuuaccuggau

SEQ ID NO: 5687 - RNA, 18 nt, artificial
  Chemically synthesized
gcacagcacaugccagac

SEQ ID NO: 5688 - RNA, 18 nt, artificial
  Chemically synthesized
ggaauggaguuuaaagau

SEQ ID NO: 5689 - RNA, 18 nt, artificial
  Chemically synthesized
caagacccacaccaucca

SEQ ID NO: 5690 - RNA, 18 nt, artificial
  Chemically synthesized
agcaggaacagagcacag

SEQ ID NO: 5691 - RNA, 18 nt, artificial
  Chemically synthesized
auaugcagccuccggauu

SEQ ID NO: 5692 - RNA, 18 nt, artificial
  Chemically synthesized
aguaggcaucccgcucac

SEQ ID NO: 5693 - RNA, 18 nt, artificial
  Chemically synthesized
aaaaaucuccagcaguaa

SEQ ID NO: 5694 - RNA, 18 nt, artificial
  Chemically synthesized
ccaguggauaguucugaa

SEQ ID NO: 5695 - RNA, 18 nt, artificial
  Chemically synthesized
cuguuguuggacagguca

SEQ ID NO: 5696 - RNA, 18 nt, artificial
  Chemically synthesized
agcaggaucagcaggaac

SEQ ID NO: 5697 - RNA, 18 nt, artificial
  Chemically synthesized
ugggccacuccagguagg

SEQ ID NO: 5698 - RNA, 18 nt, artificial
  Chemically synthesized
ugugcuggauaaguucaa

SEQ ID NO: 5699 - RNA, 18 nt, artificial
  Chemically synthesized
auggaguuuaaagauccu

SEQ ID NO: 5700 - RNA, 18 nt, artificial
  Chemically synthesized
gccuguuacacuguguau

SEQ ID NO: 5701 - RNA, 18 nt, artificial
  Chemically synthesized
aguuccucaaggaaggua

SEQ ID NO: 5702 - RNA, 18 nt, artificial
  Chemically synthesized
uccacaaaguauguggca

SEQ ID NO: 5703 - RNA, 18 nt, artificial
  Chemically synthesized
agugcuugcugcuccuga

SEQ ID NO: 5704 - RNA, 18 nt, artificial
  Chemically synthesized
aguuuucagaaagcacaa

SEQ ID NO: 5705 - RNA, 18 nt, artificial
  Chemically synthesized
cagcuccuggaccauaag

SEQ ID NO: 5706 - RNA, 18 nt, artificial
  Chemically synthesized
gaggcggacauccugaac

SEQ ID NO: 5707 - RNA, 18 nt, artificial
  Chemically synthesized
gagaggcggacauccuga

SEQ ID NO: 5708 - RNA, 18 nt, artificial
  Chemically synthesized
gaagguaaguccagcaaa

SEQ ID NO: 5709 - RNA, 18 nt, artificial
  Chemically synthesized
ggguuuuguaaggauuuc

SEQ ID NO: 5710 - RNA, 18 nt, artificial
  Chemically synthesized
ccgcuuaugaagacacaa

SEQ ID NO: 5711 - RNA, 18 nt, artificial
  Chemically synthesized
ccagaaaaacuuuacugu

SEQ ID NO: 5712 - RNA, 18 nt, artificial
  Chemically synthesized
cacuccagguaggucuug

SEQ ID NO: 5713 - RNA, 18 nt, artificial
  Chemically synthesized
gucccgcuuaugaagaca

SEQ ID NO: 5714 - RNA, 18 nt, artificial
  Chemically synthesized
uauucgugugcuggauaa

SEQ ID NO: 5715 - RNA, 18 nt, artificial
  Chemically synthesized
gcucauagcucuguagau

SEQ ID NO: 5716 - RNA, 18 nt, artificial
  Chemically synthesized
acgcacaugggauggaga

SEQ ID NO: 5717 - RNA, 18 nt, artificial
  Chemically synthesized
cuaguaacauggguaaga

SEQ ID NO: 5718 - RNA, 18 nt, artificial
  Chemically synthesized
aagguaaguccagcaaaa

SEQ ID NO: 5719 - RNA, 18 nt, artificial
  Chemically synthesized
uucuuugaguugcggcaa

SEQ ID NO: 5720 - RNA, 18 nt, artificial
  Chemically synthesized
aagacggaaaugggagaa

SEQ ID NO: 5721 - RNA, 18 nt, artificial
  Chemically synthesized
cacagcacaugccagaca

SEQ ID NO: 5722 - RNA, 18 nt, artificial
  Chemically synthesized
gucaaguugcuccuuaga

SEQ ID NO: 5723 - RNA, 18 nt, artificial
  Chemically synthesized
aggcccacaucauuuuca

SEQ ID NO: 5724 - RNA, 18 nt, artificial
  Chemically synthesized
gcucucagauuuacccaa

SEQ ID NO: 5725 - RNA, 18 nt, artificial
  Chemically synthesized
agggaggcaucugguaga

SEQ ID NO: 5726 - RNA, 18 nt, artificial
  Chemically synthesized
gcuuuccugggcuuccuu

SEQ ID NO: 5727 - RNA, 18 nt, artificial
  Chemically synthesized
caaaaaucuccagcagua

SEQ ID NO: 5728 - RNA, 18 nt, artificial
  Chemically synthesized
gcaggaucagcaggaaca

SEQ ID NO: 5729 - RNA, 18 nt, artificial
  Chemically synthesized
aaguuccucaaggaaggu

SEQ ID NO: 5730 - RNA, 18 nt, artificial
  Chemically synthesized
ccugauuggaggauucuu

SEQ ID NO: 5731 - RNA, 18 nt, artificial
  Chemically synthesized
ugcuugcugcuccugagu

SEQ ID NO: 5732 - RNA, 18 nt, artificial
  Chemically synthesized
acaugggauggagaguca

SEQ ID NO: 5733 - RNA, 18 nt, artificial
  Chemically synthesized
aguuauugccaccagcuu

SEQ ID NO: 5734 - RNA, 18 nt, artificial
  Chemically synthesized
ggcggacauccugaaccu

SEQ ID NO: 5735 - RNA, 18 nt, artificial
  Chemically synthesized
gacaggucaaggcuuuuu

SEQ ID NO: 5736 - RNA, 18 nt, artificial
  Chemically synthesized
aguaucucgcaguuccaa

SEQ ID NO: 5737 - RNA, 18 nt, artificial
  Chemically synthesized
ggaaugcagccuguuaca

SEQ ID NO: 5738 - RNA, 18 nt, artificial
  Chemically synthesized
ccucuguaggucacuguu

SEQ ID NO: 5739 - RNA, 18 nt, artificial
  Chemically synthesized
cauccucacaggcugaau

SEQ ID NO: 5740 - RNA, 18 nt, artificial
  Chemically synthesized
accauccacaaaguaugu

SEQ ID NO: 5741 - RNA, 18 nt, artificial
  Chemically synthesized
auggguaagagggaggca

SEQ ID NO: 5742 - RNA, 18 nt, artificial
  Chemically synthesized
caaacuuucaucggugau

SEQ ID NO: 5743 - RNA, 18 nt, artificial
  Chemically synthesized
cgcagcuugcagaagcgc

SEQ ID NO: 5744 - RNA, 18 nt, artificial
  Chemically synthesized
caagacagagaagccuga

SEQ ID NO: 5745 - RNA, 18 nt, artificial
  Chemically synthesized
ccaguaggcaucccgcuc

SEQ ID NO: 5746 - RNA, 18 nt, artificial
  Chemically synthesized
gaacagagcacagcacau

SEQ ID NO: 5747 - RNA, 18 nt, artificial
  Chemically synthesized
caggagcaaaugaaguua

SEQ ID NO: 5748 - RNA, 18 nt, artificial
  Chemically synthesized
ggaauucacaggagcaaa

SEQ ID NO: 5749 - RNA, 18 nt, artificial
  Chemically synthesized
ggagcuuuccugggcuuc

SEQ ID NO: 5750 - RNA, 18 nt, artificial
  Chemically synthesized
aacuccauuaaggguaca

SEQ ID NO: 5751 - RNA, 18 nt, artificial
  Chemically synthesized
aggaauucacaggagcaa

SEQ ID NO: 5752 - RNA, 18 nt, artificial
  Chemically synthesized
ggagaaguccaguucaua

SEQ ID NO: 5753 - RNA, 18 nt, artificial
  Chemically synthesized
gacccacaccauccacaa

SEQ ID NO: 5754 - RNA, 18 nt, artificial
  Chemically synthesized
ggucacaagacagagaag

SEQ ID NO: 5755 - RNA, 18 nt, artificial
  Chemically synthesized
agguaaguccagcaaaau

SEQ ID NO: 5756 - RNA, 18 nt, artificial
  Chemically synthesized
cacuuuaccuggaucuau

SEQ ID NO: 5757 - RNA, 18 nt, artificial
  Chemically synthesized
agagggaggcaucuggua

SEQ ID NO: 5758 - RNA, 18 nt, artificial
  Chemically synthesized
ggccacuccagguagguc

SEQ ID NO: 5759 - RNA, 18 nt, artificial
  Chemically synthesized
ugacaaguuucaggcaua

SEQ ID NO: 5760 - RNA, 18 nt, artificial
  Chemically synthesized
caggaucagcaggaacag

SEQ ID NO: 5761 - RNA, 18 nt, artificial
  Chemically synthesized
uggagccaggcccacauc

SEQ ID NO: 5762 - RNA, 18 nt, artificial
  Chemically synthesized
cauuccacggaacuugua

SEQ ID NO: 5763 - RNA, 18 nt, artificial
  Chemically synthesized
ccaggcauccucacaggc

SEQ ID NO: 5764 - RNA, 18 nt, artificial
  Chemically synthesized
gaagccugauuggaggau

SEQ ID NO: 5765 - RNA, 18 nt, artificial
  Chemically synthesized
ggcugaauuuuucaagua

SEQ ID NO: 5766 - RNA, 18 nt, artificial
  Chemically synthesized
ggccaggcauccucacag

SEQ ID NO: 5767 - RNA, 18 nt, artificial
  Chemically synthesized
gccacgcacaugggaugg

SEQ ID NO: 5768 - RNA, 18 nt, artificial
  Chemically synthesized
ugcagccuccggauuguu

SEQ ID NO: 5769 - RNA, 18 nt, artificial
  Chemically synthesized
guaaacaaggaaccagaa

SEQ ID NO: 5770 - RNA, 18 nt, artificial
  Chemically synthesized
cccaguaggcaucccgcu

SEQ ID NO: 5771 - RNA, 18 nt, artificial
  Chemically synthesized
gagagucacacagguaau

SEQ ID NO: 5772 - RNA, 18 nt, artificial
  Chemically synthesized
gacaguuuuguggcucuu

SEQ ID NO: 5773 - RNA, 18 nt, artificial
  Chemically synthesized
ucgcagcucucagauuua

SEQ ID NO: 5774 - RNA, 18 nt, artificial
  Chemically synthesized
cucucagauuuacccaaa

SEQ ID NO: 5775 - RNA, 18 nt, artificial
  Chemically synthesized
cacaaaguauguggcauu

SEQ ID NO: 5776 - RNA, 18 nt, artificial
  Chemically synthesized
ucuuccucuauuguguua

SEQ ID NO: 5777 - RNA, 18 nt, artificial
  Chemically synthesized
caguaggcaucccgcuca

SEQ ID NO: 5778 - RNA, 18 nt, artificial
  Chemically synthesized
uguuguuggacaggucaa

SEQ ID NO: 5779 - RNA, 18 nt, artificial
  Chemically synthesized
gagccaggcccacaucau

SEQ ID NO: 5780 - RNA, 18 nt, artificial
  Chemically synthesized
ggcuuccuuuuggccugg

SEQ ID NO: 5781 - RNA, 18 nt, artificial
  Chemically synthesized
guuuucagaaagcacaaa

SEQ ID NO: 5782 - RNA, 18 nt, artificial
  Chemically synthesized
acuuucaucggugauuuu

SEQ ID NO: 5783 - RNA, 18 nt, artificial
  Chemically synthesized
cugagggaauggaguuua

SEQ ID NO: 5784 - RNA, 18 nt, artificial
  Chemically synthesized
acaaacuuucaucgguga

SEQ ID NO: 5785 - RNA, 18 nt, artificial
  Chemically synthesized
aguugcggcaaauucaaa

SEQ ID NO: 5786 - RNA, 18 nt, artificial
  Chemically synthesized
cuugcugcuccugaguga

SEQ ID NO: 5787 - RNA, 18 nt, artificial
  Chemically synthesized
ccacuccagguaggucuu

SEQ ID NO: 5788 - RNA, 18 nt, artificial
  Chemically synthesized
gggaggcaucugguagag

SEQ ID NO: 5789 - RNA, 18 nt, artificial
  Chemically synthesized
guaggcaucccgcucacu

SEQ ID NO: 5790 - RNA, 18 nt, artificial
  Chemically synthesized
ccacaccauccacaaagu

SEQ ID NO: 5791 - RNA, 18 nt, artificial
  Chemically synthesized
gccaggcauccucacagg

SEQ ID NO: 5792 - RNA, 18 nt, artificial
  Chemically synthesized
ggcaucugguagagucau

SEQ ID NO: 5793 - RNA, 18 nt, artificial
  Chemically synthesized
ggaaugaagucccgcuua

SEQ ID NO: 5794 - RNA, 18 nt, artificial
  Chemically synthesized
caugggccacuccaggua

SEQ ID NO: 5795 - RNA, 18 nt, artificial
  Chemically synthesized
ucucagauuuacccaaaa

SEQ ID NO: 5796 - RNA, 18 nt, artificial
  Chemically synthesized
ccagugcuugcugcuccu

SEQ ID NO: 5797 - RNA, 18 nt, artificial
  Chemically synthesized
ggaggcaucugguagagu

SEQ ID NO: 5798 - RNA, 18 nt, artificial
  Chemically synthesized
ugauccacuugccaggaa

SEQ ID NO: 5799 - RNA, 18 nt, artificial
  Chemically synthesized
cacaccauccacaaagua

SEQ ID NO: 5800 - RNA, 18 nt, artificial
  Chemically synthesized
cagugcuugcugcuccug

SEQ ID NO: 5801 - RNA, 18 nt, artificial
  Chemically synthesized
uccagcuccuggaccaua

SEQ ID NO: 5802 - RNA, 18 nt, artificial
  Chemically synthesized
aggaaccagaaaaacuuu

SEQ ID NO: 5803 - RNA, 18 nt, artificial
  Chemically synthesized
gcucacuguaagaaacaa

SEQ ID NO: 5804 - RNA, 18 nt, artificial
  Chemically synthesized
aacaaggaaccagaaaaa

SEQ ID NO: 5805 - RNA, 18 nt, artificial
  Chemically synthesized
cugcuccugagugaagga

SEQ ID NO: 5806 - RNA, 18 nt, artificial
  Chemically synthesized
caggcccacaucauuuuc

SEQ ID NO: 5807 - RNA, 18 nt, artificial
  Chemically synthesized
ggaagguaaguccagcaa

SEQ ID NO: 5808 - RNA, 18 nt, artificial
  Chemically synthesized
aggaucagcaggaacaga

SEQ ID NO: 5809 - RNA, 18 nt, artificial
  Chemically synthesized
cuggagccaggcccacau

SEQ ID NO: 5810 - RNA, 18 nt, artificial
  Chemically synthesized
gguaagagggaggcaucu

SEQ ID NO: 5811 - RNA, 18 nt, artificial
  Chemically synthesized
agggccaggcauccucac

SEQ ID NO: 5812 - RNA, 18 nt, artificial
  Chemically synthesized
gcacaugggauggagagu

SEQ ID NO: 5813 - RNA, 18 nt, artificial
  Chemically synthesized
ccacucacucuucacaaa

SEQ ID NO: 5814 - RNA, 18 nt, artificial
  Chemically synthesized
caguaaaauaugcugcuu

SEQ ID NO: 5815 - RNA, 18 nt, artificial
  Chemically synthesized
ggugauccuguuguugga

SEQ ID NO: 5816 - RNA, 18 nt, artificial
  Chemically synthesized
ggcaucccgcucacugua

SEQ ID NO: 5817 - RNA, 18 nt, artificial
  Chemically synthesized
ggagcaaaugaaguuauu

SEQ ID NO: 5818 - RNA, 18 nt, artificial
  Chemically synthesized
guggauaguucugaaaaa

SEQ ID NO: 5819 - RNA, 18 nt, artificial
  Chemically synthesized
agccaggcccacaucauu

SEQ ID NO: 5820 - RNA, 18 nt, artificial
  Chemically synthesized
gccaggcccacaucauuu

SEQ ID NO: 5821 - RNA, 18 nt, artificial
  Chemically synthesized
cggcaaauucaaagaaaa

SEQ ID NO: 5822 - RNA, 18 nt, artificial
  Chemically synthesized
ggcccacaucauuuucau

SEQ ID NO: 5823 - RNA, 18 nt, artificial
  Chemically synthesized
gcaucccgcucacuguaa

SEQ ID NO: 5824 - RNA, 18 nt, artificial
  Chemically synthesized
cccagggaagaaaaagaa

SEQ ID NO: 5825 - RNA, 18 nt, artificial
  Chemically synthesized
ccagggaagaaaaagaau

SEQ ID NO: 5826 - RNA, 18 nt, artificial
  Chemically synthesized
gggaagaaaaagaaucuu

SEQ ID NO: 5827 - RNA, 18 nt, artificial
  Chemically synthesized
guuuccacuuuaccugga

SEQ ID NO: 5828 - RNA, 18 nt, artificial
  Chemically synthesized
ccacgcacaugggaugga

SEQ ID NO: 5829 - RNA, 18 nt, artificial
  Chemically synthesized
agguaauuugcuggccaa

SEQ ID NO: 5830 - RNA, 18 nt, artificial
  Chemically synthesized
ugagggaauggaguuuaa

SEQ ID NO: 5831 - RNA, 18 nt, artificial
  Chemically synthesized
gagagggccaggcauccu

SEQ ID NO: 5832 - RNA, 18 nt, artificial
  Chemically synthesized
gcccacaucauuuucaua

SEQ ID NO: 5833 - RNA, 18 nt, artificial
  Chemically synthesized
ccaggcccacaucauuuu

SEQ ID NO: 5834 - RNA, 18 nt, artificial
  Chemically synthesized
gagggccaggcauccuca

SEQ ID NO: 5835 - RNA, 18 nt, artificial
  Chemically synthesized
ggaaccagaaaaacuuua

SEQ ID NO: 5836 - RNA, 18 nt, artificial
  Chemically synthesized
cuuuaccuggaucuauaa

SEQ ID NO: 5837 - RNA, 18 nt, artificial
  Chemically synthesized
cuggccacgcacauggga

SEQ ID NO: 5838 - RNA, 18 nt, artificial
  Chemically synthesized
gggccaggcauccucaca

SEQ ID NO: 5839 - RNA, 18 nt, artificial
  Chemically synthesized
acccacaccauccacaaa

SEQ ID NO: 5840 - RNA, 18 nt, artificial
  Chemically synthesized
ccuggagccaggcccaca

SEQ ID NO: 5841 - RNA, 18 nt, artificial
  Chemically synthesized
gguaauuugcuggccaau

SEQ ID NO: 5842 - RNA, 18 nt, artificial
  Chemically synthesized
gcuuccuuuuggccugga

SEQ ID NO: 5843 - RNA, 18 nt, artificial
  Chemically synthesized
gcauccucacaggcugaa

SEQ ID NO: 5844 - RNA, 18 nt, artificial
  Chemically synthesized
ggcauccucacaggcuga

SEQ ID NO: 5845 - RNA, 18 nt, artificial
  Chemically synthesized
gccuggagccaggcccac

SEQ ID NO: 5846 - RNA, 18 nt, Artificial Sequence
  Chemically synthesized
cugcccagggaagaaaaa

SEQ ID NO: 5847 - RNA, 19 nt, artificial
  Chemically synthesized
ggcuguggagacaaaucua

SEQ ID NO: 5848 - RNA, 19 nt, artificial
  Chemically synthesized
gggagaauuuagaaaugaa

SEQ ID NO: 5849 - RNA, 19 nt, artificial
  Chemically synthesized
ggaguugucuaauugguau

SEQ ID NO: 5850 - RNA, 19 nt, artificial
  Chemically synthesized
ggcuugaguuucaaagguu

SEQ ID NO: 5851 - RNA, 19 nt, artificial
  Chemically synthesized
ggucuagggugauugaaca

SEQ ID NO: 5852 - RNA, 19 nt, artificial
  Chemically synthesized
gggaguugucuaauuggua

SEQ ID NO: 5853 - RNA, 19 nt, artificial
  Chemically synthesized
ggaaauagggaguugucua

SEQ ID NO: 5854 - RNA, 19 nt, artificial
  Chemically synthesized
guuucuagaucucaguaga

SEQ ID NO: 5855 - RNA, 19 nt, artificial
  Chemically synthesized
ggauguuaucauugagaaa

SEQ ID NO: 5856 - RNA, 19 nt, artificial
  Chemically synthesized
ggugagugugacuauugaa

SEQ ID NO: 5857 - RNA, 19 nt, artificial
  Chemically synthesized
ggcucacaaucuuauccaa

SEQ ID NO: 5858 - RNA, 19 nt, artificial
  Chemically synthesized
gucuuaucauggacaauuu

SEQ ID NO: 5859 - RNA, 19 nt, artificial
  Chemically synthesized
agaagagagugugauuaua

SEQ ID NO: 5860 - RNA, 19 nt, artificial
  Chemically synthesized
gaguugucuaauugguaua

SEQ ID NO: 5861 - RNA, 19 nt, artificial
  Chemically synthesized
ggcaauucuuuccaggaaa

SEQ ID NO: 5862 - RNA, 19 nt, artificial
  Chemically synthesized
cccagaacugcuuugaaua

SEQ ID NO: 5863 - RNA, 19 nt, artificial
  Chemically synthesized
gcaugaucauaucuguaua

SEQ ID NO: 5864 - RNA, 19 nt, artificial
  Chemically synthesized
guuugagaugaguucucua

SEQ ID NO: 5865 - RNA, 19 nt, artificial
  Chemically synthesized
cagacuugcggguucuaca

SEQ ID NO: 5866 - RNA, 19 nt, artificial
  Chemically synthesized
ggaaugagcuaguaaagaa

SEQ ID NO: 5867 - RNA, 19 nt, artificial
  Chemically synthesized
gucuauggcuguuugagau

SEQ ID NO: 5868 - RNA, 19 nt, artificial
  Chemically synthesized
ggugugaaauccagacaau

SEQ ID NO: 5869 - RNA, 19 nt, artificial
  Chemically synthesized
ccaccucucuaccuuaaua

SEQ ID NO: 5870 - RNA, 19 nt, artificial
  Chemically synthesized
gccuugaguuucuagaucu

SEQ ID NO: 5871 - RNA, 19 nt, artificial
  Chemically synthesized
ugguggcuguggagacaaa

SEQ ID NO: 5872 - RNA, 19 nt, artificial
  Chemically synthesized
gaaauagggaguugucuaa

SEQ ID NO: 5873 - RNA, 19 nt, artificial
  Chemically synthesized
gaguugcagcagaaguuua

SEQ ID NO: 5874 - RNA, 19 nt, artificial
  Chemically synthesized
ccuucacuacagagacuuu

SEQ ID NO: 5875 - RNA, 19 nt, artificial
  Chemically synthesized
gaagguucccagaaaagaa

SEQ ID NO: 5876 - RNA, 19 nt, artificial
  Chemically synthesized
aggucuggcugguuuagaa

SEQ ID NO: 5877 - RNA, 19 nt, artificial
  Chemically synthesized
cucuugugcuuguacagua

SEQ ID NO: 5878 - RNA, 19 nt, artificial
  Chemically synthesized
cauccagccuccucagaaa

SEQ ID NO: 5879 - RNA, 19 nt, artificial
  Chemically synthesized
cuuucaaauuaccugagua

SEQ ID NO: 5880 - RNA, 19 nt, artificial
  Chemically synthesized
guggcuaauuccuaaggaa

SEQ ID NO: 5881 - RNA, 19 nt, artificial
  Chemically synthesized
gggaguauacauugcuguu

SEQ ID NO: 5882 - RNA, 19 nt, artificial
  Chemically synthesized
agcucuugguggaaguuga

SEQ ID NO: 5883 - RNA, 19 nt, artificial
  Chemically synthesized
gucucauguacuagugaaa

SEQ ID NO: 5884 - RNA, 19 nt, artificial
  Chemically synthesized
cgagcauguucuauuuuuu

SEQ ID NO: 5885 - RNA, 19 nt, artificial
  Chemically synthesized
gcuguuuccuguugggcaa

SEQ ID NO: 5886 - RNA, 19 nt, artificial
  Chemically synthesized
ggcuuacuuucacuuccaa

SEQ ID NO: 5887 - RNA, 19 nt, artificial
  Chemically synthesized
agaguuuccugcaauggau

SEQ ID NO: 5888 - RNA, 19 nt, artificial
  Chemically synthesized
ccuuaauauugacaggaaa

SEQ ID NO: 5889 - RNA, 19 nt, artificial
  Chemically synthesized
gcaauucuuuccaggaaaa

SEQ ID NO: 5890 - RNA, 19 nt, artificial
  Chemically synthesized
gcauuuuccaaguagucua

SEQ ID NO: 5891 - RNA, 19 nt, artificial
  Chemically synthesized
agccaccucucuaccuuaa

SEQ ID NO: 5892 - RNA, 19 nt, artificial
  Chemically synthesized
cacauaaugacuuccaaaa

SEQ ID NO: 5893 - RNA, 19 nt, artificial
  Chemically synthesized
ggguaaaagacuuuucuua

SEQ ID NO: 5894 - RNA, 19 nt, artificial
  Chemically synthesized
gguccucagugugcuugua

SEQ ID NO: 5895 - RNA, 19 nt, artificial
  Chemically synthesized
cuguaaauuuggacaguuu

SEQ ID NO: 5896 - RNA, 19 nt, artificial
  Chemically synthesized
ggcggcucgaggaagagaa

SEQ ID NO: 5897 - RNA, 19 nt, artificial
  Chemically synthesized
ggaguauacauugcuguuu

SEQ ID NO: 5898 - RNA, 19 nt, artificial
  Chemically synthesized
aguagucuagcuuucuuaa

SEQ ID NO: 5899 - RNA, 19 nt, artificial
  Chemically synthesized
gaguuucuagaucucagua

SEQ ID NO: 5900 - RNA, 19 nt, artificial
  Chemically synthesized
gccuuuguuaucuacucaa

SEQ ID NO: 5901 - RNA, 19 nt, artificial
  Chemically synthesized
gggcauuucaaccaacuca

SEQ ID NO: 5902 - RNA, 19 nt, artificial
  Chemically synthesized
ugaccaaucuagagcacuu

SEQ ID NO: 5903 - RNA, 19 nt, artificial
  Chemically synthesized
gcuugaguuucaaagguug

SEQ ID NO: 5904 - RNA, 19 nt, artificial
  Chemically synthesized
caugaagguuuccauaaaa

SEQ ID NO: 5905 - RNA, 19 nt, artificial
  Chemically synthesized
ggaccucugaaucucuuua

SEQ ID NO: 5906 - RNA, 19 nt, artificial
  Chemically synthesized
ggucuuaucauggacaauu

SEQ ID NO: 5907 - RNA, 19 nt, artificial
  Chemically synthesized
gguggcuguggagacaaau

SEQ ID NO: 5908 - RNA, 19 nt, artificial
  Chemically synthesized
cucucaaaaggcuuacuuu

SEQ ID NO: 5909 - RNA, 19 nt, artificial
  Chemically synthesized
gacaaaucuagcaucucua

SEQ ID NO: 5910 - RNA, 19 nt, artificial
  Chemically synthesized
cuggagacgacucagaaaa

SEQ ID NO: 5911 - RNA, 19 nt, artificial
  Chemically synthesized
caaugugucuggaauuaau

SEQ ID NO: 5912 - RNA, 19 nt, artificial
  Chemically synthesized
guuugguucugggagaauu

SEQ ID NO: 5913 - RNA, 19 nt, artificial
  Chemically synthesized
gaagagagugugauuauau

SEQ ID NO: 5914 - RNA, 19 nt, artificial
  Chemically synthesized
ggaaauaugaccacaguca

SEQ ID NO: 5915 - RNA, 19 nt, artificial
  Chemically synthesized
augcuaagggugaguaauu

SEQ ID NO: 5916 - RNA, 19 nt, artificial
  Chemically synthesized
gcguuuucuucuucuaacu

SEQ ID NO: 5917 - RNA, 19 nt, artificial
  Chemically synthesized
gacaguuucccacauugaa

SEQ ID NO: 5918 - RNA, 19 nt, artificial
  Chemically synthesized
gagaaaacagaaagagaca

SEQ ID NO: 5919 - RNA, 19 nt, artificial
  Chemically synthesized
gggcaaugcuccuugacca

SEQ ID NO: 5920 - RNA, 19 nt, artificial
  Chemically synthesized
gucugaaugaagcuauaaa

SEQ ID NO: 5921 - RNA, 19 nt, artificial
  Chemically synthesized
agacuugcggguucuacau

SEQ ID NO: 5922 - RNA, 19 nt, artificial
  Chemically synthesized
ggccuuaugcuaaggguga

SEQ ID NO: 5923 - RNA, 19 nt, artificial
  Chemically synthesized
agaaauggcuugaguuuca

SEQ ID NO: 5924 - RNA, 19 nt, artificial
  Chemically synthesized
caguucuggucuauaaguu

SEQ ID NO: 5925 - RNA, 19 nt, artificial
  Chemically synthesized
gugacuauugaaaggguaa

SEQ ID NO: 5926 - RNA, 19 nt, artificial
  Chemically synthesized
guagaaauggcuugaguuu

SEQ ID NO: 5927 - RNA, 19 nt, artificial
  Chemically synthesized
ggcuguuugagaugaguuc

SEQ ID NO: 5928 - RNA, 19 nt, artificial
  Chemically synthesized
ucuagaucucaguagaaau

SEQ ID NO: 5929 - RNA, 19 nt, artificial
  Chemically synthesized
agaacuacgugugaaggua

SEQ ID NO: 5930 - RNA, 19 nt, artificial
  Chemically synthesized
gugacaaaagagauaacua

SEQ ID NO: 5931 - RNA, 19 nt, artificial
  Chemically synthesized
cacucagaaaccucauuua

SEQ ID NO: 5932 - RNA, 19 nt, artificial
  Chemically synthesized
ggcaacauuuagaauuagu

SEQ ID NO: 5933 - RNA, 19 nt, artificial
  Chemically synthesized
caccagaguugcuuucaau

SEQ ID NO: 5934 - RNA, 19 nt, artificial
  Chemically synthesized
ugcggguucuacaucaaau

SEQ ID NO: 5935 - RNA, 19 nt, artificial
  Chemically synthesized
gcuuguaguaucuguugua

SEQ ID NO: 5936 - RNA, 19 nt, artificial
  Chemically synthesized
guugaauaaagacagagaa

SEQ ID NO: 5937 - RNA, 19 nt, artificial
  Chemically synthesized
gcaguucuggucuauaagu

SEQ ID NO: 5938 - RNA, 19 nt, artificial
  Chemically synthesized
aguugaucuaccaagccuu

SEQ ID NO: 5939 - RNA, 19 nt, artificial
  Chemically synthesized
augucugaaugaagcuaua

SEQ ID NO: 5940 - RNA, 19 nt, artificial
  Chemically synthesized
gaguuuucaguauuccuau

SEQ ID NO: 5941 - RNA, 19 nt, artificial
  Chemically synthesized
ggaaguauggaaaaguaca

SEQ ID NO: 5942 - RNA, 19 nt, artificial
  Chemically synthesized
gcugguggcuguggagaca

SEQ ID NO: 5943 - RNA, 19 nt, artificial
  Chemically synthesized
cacucgaugucauuccaaa

SEQ ID NO: 5944 - RNA, 19 nt, artificial
  Chemically synthesized
gagucuuccaggugggcau

SEQ ID NO: 5945 - RNA, 19 nt, artificial
  Chemically synthesized
guuugacaaaucugcucua

SEQ ID NO: 5946 - RNA, 19 nt, artificial
  Chemically synthesized
agaugaguucucuacucuu

SEQ ID NO: 5947 - RNA, 19 nt, artificial
  Chemically synthesized
cuuucaauggcaucuucaa

SEQ ID NO: 5948 - RNA, 19 nt, artificial
  Chemically synthesized
ggaagggagaaaugaggaa

SEQ ID NO: 5949 - RNA, 19 nt, artificial
  Chemically synthesized
cgugcuucaaauauccaua

SEQ ID NO: 5950 - RNA, 19 nt, artificial
  Chemically synthesized
gccgaaaggugauuguugu

SEQ ID NO: 5951 - RNA, 19 nt, artificial
  Chemically synthesized
cagucagaaguguuuguua

SEQ ID NO: 5952 - RNA, 19 nt, artificial
  Chemically synthesized
ccugugacaaaagagauaa

SEQ ID NO: 5953 - RNA, 19 nt, artificial
  Chemically synthesized
ggcaggaagcaacaucuau

SEQ ID NO: 5954 - RNA, 19 nt, artificial
  Chemically synthesized
gggcuguguguauuugaaa

SEQ ID NO: 5955 - RNA, 19 nt, artificial
  Chemically synthesized
gucucgaagucuugaaaau

SEQ ID NO: 5956 - RNA, 19 nt, artificial
  Chemically synthesized
aaagaagguucccagaaaa

SEQ ID NO: 5957 - RNA, 19 nt, artificial
  Chemically synthesized
guucuugauuacagucuca

SEQ ID NO: 5958 - RNA, 19 nt, artificial
  Chemically synthesized
ggaucaaggaccagaggca

SEQ ID NO: 5959 - RNA, 19 nt, artificial
  Chemically synthesized
gagucuuuugaauggaaau

SEQ ID NO: 5960 - RNA, 19 nt, artificial
  Chemically synthesized
ccagguucuugauuacagu

SEQ ID NO: 5961 - RNA, 19 nt, artificial
  Chemically synthesized
ggcagcagguggagcugua

SEQ ID NO: 5962 - RNA, 19 nt, artificial
  Chemically synthesized
guuugauggaccucugaau

SEQ ID NO: 5963 - RNA, 19 nt, artificial
  Chemically synthesized
ggauggcaacauuuagaau

SEQ ID NO: 5964 - RNA, 19 nt, artificial
  Chemically synthesized
ggcugguuuagaaguccau

SEQ ID NO: 5965 - RNA, 19 nt, artificial
  Chemically synthesized
aauagggaguugucuaauu

SEQ ID NO: 5966 - RNA, 19 nt, artificial
  Chemically synthesized
acaucauccaugaagguuu

SEQ ID NO: 5967 - RNA, 19 nt, artificial
  Chemically synthesized
aguccagaaugcuaagguu

SEQ ID NO: 5968 - RNA, 19 nt, artificial
  Chemically synthesized
accucaucaaguugaauaa

SEQ ID NO: 5969 - RNA, 19 nt, artificial
  Chemically synthesized
gaugaauaagaccaucauu

SEQ ID NO: 5970 - RNA, 19 nt, artificial
  Chemically synthesized
cuucacuacagagacuuua

SEQ ID NO: 5971 - RNA, 19 nt, artificial
  Chemically synthesized
guuugaauaucaccuguca

SEQ ID NO: 5972 - RNA, 19 nt, artificial
  Chemically synthesized
ggagcaguugucuccaaca

SEQ ID NO: 5973 - RNA, 19 nt, artificial
  Chemically synthesized
aagaauuccgauuagcaua

SEQ ID NO: 5974 - RNA, 19 nt, artificial
  Chemically synthesized
caauuugaccauugaagaa

SEQ ID NO: 5975 - RNA, 19 nt, artificial
  Chemically synthesized
cauuugaaauggaugucua

SEQ ID NO: 5976 - RNA, 19 nt, artificial
  Chemically synthesized
ccuaaggaaaccugauuaa

SEQ ID NO: 5977 - RNA, 19 nt, artificial
  Chemically synthesized
gccugugcugaguuugaau

SEQ ID NO: 5978 - RNA, 19 nt, artificial
  Chemically synthesized
ggaacccaugacaaagaaa

SEQ ID NO: 5979 - RNA, 19 nt, artificial
  Chemically synthesized
ggacaucucaaaacuuuga

SEQ ID NO: 5980 - RNA, 19 nt, artificial
  Chemically synthesized
gguucuuauaaagaagguu

SEQ ID NO: 5981 - RNA, 19 nt, artificial
  Chemically synthesized
gcaggucuagggugauuga

SEQ ID NO: 5982 - RNA, 19 nt, artificial
  Chemically synthesized
gaacuacgugugaagguau

SEQ ID NO: 5983 - RNA, 19 nt, artificial
  Chemically synthesized
gccuauaagcuaauaucau

SEQ ID NO: 5984 - RNA, 19 nt, artificial
  Chemically synthesized
ccauugaagaauuccgauu

SEQ ID NO: 5985 - RNA, 19 nt, artificial
  Chemically synthesized
gguuguuuaagacgugcuu

SEQ ID NO: 5986 - RNA, 19 nt, artificial
  Chemically synthesized
guauuuauugcacagacuu

SEQ ID NO: 5987 - RNA, 19 nt, artificial
  Chemically synthesized
ccucagugugcuuguagua

SEQ ID NO: 5988 - RNA, 19 nt, artificial
  Chemically synthesized
gacuauugaaaggguaaaa

SEQ ID NO: 5989 - RNA, 19 nt, artificial
  Chemically synthesized
cagaacaagugauguuuga

SEQ ID NO: 5990 - RNA, 19 nt, artificial
  Chemically synthesized
gcaguugucuccaacagca

SEQ ID NO: 5991 - RNA, 19 nt, artificial
  Chemically synthesized
ggaaugugcaacaccuuca

SEQ ID NO: 5992 - RNA, 19 nt, artificial
  Chemically synthesized
aguauuuauugcacagacu

SEQ ID NO: 5993 - RNA, 19 nt, artificial
  Chemically synthesized
ggcuagaggcaggaaggaa

SEQ ID NO: 5994 - RNA, 19 nt, artificial
  Chemically synthesized
ccagcauuccaauuugaaa

SEQ ID NO: 5995 - RNA, 19 nt, artificial
  Chemically synthesized
ucuucauuguccugcagaa

SEQ ID NO: 5996 - RNA, 19 nt, artificial
  Chemically synthesized
ggauuuccagcauuccaau

SEQ ID NO: 5997 - RNA, 19 nt, artificial
  Chemically synthesized
gaccuuuccagcaacaaga

SEQ ID NO: 5998 - RNA, 19 nt, artificial
  Chemically synthesized
agccuaagccaccucucua

SEQ ID NO: 5999 - RNA, 19 nt, artificial
  Chemically synthesized
ggcguuuucuucuucuaac

SEQ ID NO: 6000 - RNA, 19 nt, artificial
  Chemically synthesized
ccugugcugaguuugaaua

SEQ ID NO: 6001 - RNA, 19 nt, artificial
  Chemically synthesized
ccagcuggguccaacacuu

SEQ ID NO: 6002 - RNA, 19 nt, artificial
  Chemically synthesized
cugagucuuuugaauggaa

SEQ ID NO: 6003 - RNA, 19 nt, artificial
  Chemically synthesized
cucuuuagggagacacaga

SEQ ID NO: 6004 - RNA, 19 nt, artificial
  Chemically synthesized
cagugugcuuguaguaucu

SEQ ID NO: 6005 - RNA, 19 nt, artificial
  Chemically synthesized
cuuggaaaaguuugacaaa

SEQ ID NO: 6006 - RNA, 19 nt, artificial
  Chemically synthesized
gaagggagaaaugaggaaa

SEQ ID NO: 6007 - RNA, 19 nt, artificial
  Chemically synthesized
caaagguugcuguucucaa

SEQ ID NO: 6008 - RNA, 19 nt, artificial
  Chemically synthesized
ccucauuuaccuugacauu

SEQ ID NO: 6009 - RNA, 19 nt, artificial
  Chemically synthesized
cuaccucgaugauauuauu

SEQ ID NO: 6010 - RNA, 19 nt, artificial
  Chemically synthesized
gaaacaaaugagugaguuu

SEQ ID NO: 6011 - RNA, 19 nt, artificial
  Chemically synthesized
cuuugcuuguacuugugaa

SEQ ID NO: 6012 - RNA, 19 nt, artificial
  Chemically synthesized
ucuaguggcuaauuccuaa

SEQ ID NO: 6013 - RNA, 19 nt, artificial
  Chemically synthesized
gucuaguggcuaauuccua

SEQ ID NO: 6014 - RNA, 19 nt, artificial
  Chemically synthesized
gaccauugaagaauuccga

SEQ ID NO: 6015 - RNA, 19 nt, artificial
  Chemically synthesized
cuuuagaccugucccugaa

SEQ ID NO: 6016 - RNA, 19 nt, artificial
  Chemically synthesized
aguguuucagaguguguuu

SEQ ID NO: 6017 - RNA, 19 nt, artificial
  Chemically synthesized
gugugaaauccagacaauu

SEQ ID NO: 6018 - RNA, 19 nt, artificial
  Chemically synthesized
aucuagcaucucuagagaa

SEQ ID NO: 6019 - RNA, 19 nt, artificial
  Chemically synthesized
cuugauuccagaaacauau

SEQ ID NO: 6020 - RNA, 19 nt, artificial
  Chemically synthesized
gaguggauguuaucauuga

SEQ ID NO: 6021 - RNA, 19 nt, artificial
  Chemically synthesized
agggagaaaugaggaaaua

SEQ ID NO: 6022 - RNA, 19 nt, artificial
  Chemically synthesized
gagaugaguucucuacucu

SEQ ID NO: 6023 - RNA, 19 nt, artificial
  Chemically synthesized
cccauuggacaucucaaaa

SEQ ID NO: 6024 - RNA, 19 nt, artificial
  Chemically synthesized
gauuagcauacuuagacua

SEQ ID NO: 6025 - RNA, 19 nt, artificial
  Chemically synthesized
gguucuugauuacagucuc

SEQ ID NO: 6026 - RNA, 19 nt, artificial
  Chemically synthesized
aggugggcauuucaaccaa

SEQ ID NO: 6027 - RNA, 19 nt, artificial
  Chemically synthesized
gcagcagaaguuuauuuuu

SEQ ID NO: 6028 - RNA, 19 nt, artificial
  Chemically synthesized
caggagaacuacgugugaa

SEQ ID NO: 6029 - RNA, 19 nt, artificial
  Chemically synthesized
ggcuguguguauuugaaag

SEQ ID NO: 6030 - RNA, 19 nt, artificial
  Chemically synthesized
accucucuaccuuaauauu

SEQ ID NO: 6031 - RNA, 19 nt, artificial
  Chemically synthesized
guagucuagcuuucuuaaa

SEQ ID NO: 6032 - RNA, 19 nt, artificial
  Chemically synthesized
ccagucucgaagucuugaa

SEQ ID NO: 6033 - RNA, 19 nt, artificial
  Chemically synthesized
cuggucuuaucauggacaa

SEQ ID NO: 6034 - RNA, 19 nt, artificial
  Chemically synthesized
cucagaaacagaacauuca

SEQ ID NO: 6035 - RNA, 19 nt, artificial
  Chemically synthesized
caaaaguccagaaugcuaa

SEQ ID NO: 6036 - RNA, 19 nt, artificial
  Chemically synthesized
caggcguuuucuucuucua

SEQ ID NO: 6037 - RNA, 19 nt, artificial
  Chemically synthesized
guuaaagucuaguggcuaa

SEQ ID NO: 6038 - RNA, 19 nt, artificial
  Chemically synthesized
uggcuaauuccuaaggaaa

SEQ ID NO: 6039 - RNA, 19 nt, artificial
  Chemically synthesized
gcuguuugagaugaguucu

SEQ ID NO: 6040 - RNA, 19 nt, artificial
  Chemically synthesized
gcggguucuacaucaaaug

SEQ ID NO: 6041 - RNA, 19 nt, artificial
  Chemically synthesized
guuuaagacgugcuucaaa

SEQ ID NO: 6042 - RNA, 19 nt, artificial
  Chemically synthesized
gguguguuuccaugucuca

SEQ ID NO: 6043 - RNA, 19 nt, artificial
  Chemically synthesized
gacuaucaaguuuacagaa

SEQ ID NO: 6044 - RNA, 19 nt, artificial
  Chemically synthesized
cuugaagaauacauccauu

SEQ ID NO: 6045 - RNA, 19 nt, artificial
  Chemically synthesized
aguagaaauggcuugaguu

SEQ ID NO: 6046 - RNA, 19 nt, artificial
  Chemically synthesized
cacagacuugcggguucua

SEQ ID NO: 6047 - RNA, 19 nt, artificial
  Chemically synthesized
cagagaaaacagaaagaga

SEQ ID NO: 6048 - RNA, 19 nt, artificial
  Chemically synthesized
ugcuuugaauacaccaauu

SEQ ID NO: 6049 - RNA, 19 nt, artificial
  Chemically synthesized
ggaagagaagacaccagug

SEQ ID NO: 6050 - RNA, 19 nt, artificial
  Chemically synthesized
ccaaaaaacaggaacuaca

SEQ ID NO: 6051 - RNA, 19 nt, artificial
  Chemically synthesized
agggaguugucuaauuggu

SEQ ID NO: 6052 - RNA, 19 nt, artificial
  Chemically synthesized
gaaacagaacauucaagaa

SEQ ID NO: 6053 - RNA, 19 nt, artificial
  Chemically synthesized
cuuccucuccugugacaaa

SEQ ID NO: 6054 - RNA, 19 nt, artificial
  Chemically synthesized
acuugcggguucuacauca

SEQ ID NO: 6055 - RNA, 19 nt, artificial
  Chemically synthesized
ggguaaggaaugagcuagu

SEQ ID NO: 6056 - RNA, 19 nt, artificial
  Chemically synthesized
aguaaugacugucaugaaa

SEQ ID NO: 6057 - RNA, 19 nt, artificial
  Chemically synthesized
agggcuguguguauuugaa

SEQ ID NO: 6058 - RNA, 19 nt, artificial
  Chemically synthesized
ggguguucacuuuuuccuu

SEQ ID NO: 6059 - RNA, 19 nt, artificial
  Chemically synthesized
cagucucgaagucuugaaa

SEQ ID NO: 6060 - RNA, 19 nt, artificial
  Chemically synthesized
ggaaaaggaggaagggaga

SEQ ID NO: 6061 - RNA, 19 nt, artificial
  Chemically synthesized
agccuuuucuggacuauca

SEQ ID NO: 6062 - RNA, 19 nt, artificial
  Chemically synthesized
cuaacuuccucuccuguga

SEQ ID NO: 6063 - RNA, 19 nt, artificial
  Chemically synthesized
ugucuauggcuguuugaga

SEQ ID NO: 6064 - RNA, 19 nt, artificial
  Chemically synthesized
gagaaacaaaaguccagaa

SEQ ID NO: 6065 - RNA, 19 nt, artificial
  Chemically synthesized
gaccacagucagaaguguu

SEQ ID NO: 6066 - RNA, 19 nt, artificial
  Chemically synthesized
gacagagaaaacagaaaga

SEQ ID NO: 6067 - RNA, 19 nt, artificial
  Chemically synthesized
gccacugcugcucacagaa

SEQ ID NO: 6068 - RNA, 19 nt, artificial
  Chemically synthesized
gaagaauacauccauuuga

SEQ ID NO: 6069 - RNA, 19 nt, artificial
  Chemically synthesized
ccugauuaacacaugcuca

SEQ ID NO: 6070 - RNA, 19 nt, artificial
  Chemically synthesized
cccuggugagugugacuau

SEQ ID NO: 6071 - RNA, 19 nt, artificial
  Chemically synthesized
aagacagagaaaacagaaa

SEQ ID NO: 6072 - RNA, 19 nt, artificial
  Chemically synthesized
uggauguuaucauugagaa

SEQ ID NO: 6073 - RNA, 19 nt, artificial
  Chemically synthesized
caccagaguuuccugcaau

SEQ ID NO: 6074 - RNA, 19 nt, artificial
  Chemically synthesized
cuccugcgugagaccagaa

SEQ ID NO: 6075 - RNA, 19 nt, artificial
  Chemically synthesized
ugugcaacaccuucagaua

SEQ ID NO: 6076 - RNA, 19 nt, artificial
  Chemically synthesized
ccagucuucagguacuaaa

SEQ ID NO: 6077 - RNA, 19 nt, artificial
  Chemically synthesized
ggcuucauaagcugacuuu

SEQ ID NO: 6078 - RNA, 19 nt, artificial
  Chemically synthesized
accuuaauauugacaggaa

SEQ ID NO: 6079 - RNA, 19 nt, artificial
  Chemically synthesized
cgauuagcauacuuagacu

SEQ ID NO: 6080 - RNA, 19 nt, artificial
  Chemically synthesized
ccaacacuuguucaguuaa

SEQ ID NO: 6081 - RNA, 19 nt, artificial
  Chemically synthesized
gaaaacagaaagagacauu

SEQ ID NO: 6082 - RNA, 19 nt, artificial
  Chemically synthesized
ggcuaauuccuaaggaaac

SEQ ID NO: 6083 - RNA, 19 nt, artificial
  Chemically synthesized
ggguucuuauaaagaaggu

SEQ ID NO: 6084 - RNA, 19 nt, artificial
  Chemically synthesized
cuagcaucucuagagaacu

SEQ ID NO: 6085 - RNA, 19 nt, artificial
  Chemically synthesized
guucuuuuccugagucuuu

SEQ ID NO: 6086 - RNA, 19 nt, artificial
  Chemically synthesized
acuucuugggcuuagaaca

SEQ ID NO: 6087 - RNA, 19 nt, artificial
  Chemically synthesized
aagccaccucucuaccuua

SEQ ID NO: 6088 - RNA, 19 nt, artificial
  Chemically synthesized
gguguucacuuuuuccuuu

SEQ ID NO: 6089 - RNA, 19 nt, artificial
  Chemically synthesized
caaccaacucagucaagga

SEQ ID NO: 6090 - RNA, 19 nt, artificial
  Chemically synthesized
ggagaauuuagaaaugaag

SEQ ID NO: 6091 - RNA, 19 nt, artificial
  Chemically synthesized
aggcguuuucuucuucuaa

SEQ ID NO: 6092 - RNA, 19 nt, artificial
  Chemically synthesized
ggaaaaguuugacaaaucu

SEQ ID NO: 6093 - RNA, 19 nt, artificial
  Chemically synthesized
ugaguuucuagaucucagu

SEQ ID NO: 6094 - RNA, 19 nt, artificial
  Chemically synthesized
ucucgagcauguucuauuu

SEQ ID NO: 6095 - RNA, 19 nt, artificial
  Chemically synthesized
uguccagucucgaagucuu

SEQ ID NO: 6096 - RNA, 19 nt, artificial
  Chemically synthesized
ugcuguucucaaagugauu

SEQ ID NO: 6097 - RNA, 19 nt, artificial
  Chemically synthesized
guggguacaggaugcaauu

SEQ ID NO: 6098 - RNA, 19 nt, artificial
  Chemically synthesized
gcucuugguggaaguugaa

SEQ ID NO: 6099 - RNA, 19 nt, artificial
  Chemically synthesized
ggaugucuauggcuguuug

SEQ ID NO: 6100 - RNA, 19 nt, artificial
  Chemically synthesized
acaguuucccacauugaaa

SEQ ID NO: 6101 - RNA, 19 nt, artificial
  Chemically synthesized
ccugcuggaugguaaauca

SEQ ID NO: 6102 - RNA, 19 nt, artificial
  Chemically synthesized
guucuggucuauaaguucu

SEQ ID NO: 6103 - RNA, 19 nt, artificial
  Chemically synthesized
ggaacaguggguacaggau

SEQ ID NO: 6104 - RNA, 19 nt, artificial
  Chemically synthesized
gagccgcugguguaucuuu

SEQ ID NO: 6105 - RNA, 19 nt, artificial
  Chemically synthesized
ugagugaguuuucaguauu

SEQ ID NO: 6106 - RNA, 19 nt, artificial
  Chemically synthesized
caaguagucuagcuuucuu

SEQ ID NO: 6107 - RNA, 19 nt, artificial
  Chemically synthesized
guuauuaccaugaguucaa

SEQ ID NO: 6108 - RNA, 19 nt, artificial
  Chemically synthesized
gaaacauaugggcugauaa

SEQ ID NO: 6109 - RNA, 19 nt, artificial
  Chemically synthesized
agacuaaaauacagagucu

SEQ ID NO: 6110 - RNA, 19 nt, artificial
  Chemically synthesized
guuauugccuacuaaguaa

SEQ ID NO: 6111 - RNA, 19 nt, artificial
  Chemically synthesized
gacaccagugccucagaaa

SEQ ID NO: 6112 - RNA, 19 nt, artificial
  Chemically synthesized
guucaaacuucuugggcuu

SEQ ID NO: 6113 - RNA, 19 nt, artificial
  Chemically synthesized
ggaugguaaaucauggaau

SEQ ID NO: 6114 - RNA, 19 nt, artificial
  Chemically synthesized
uggugagugugacuauuga

SEQ ID NO: 6115 - RNA, 19 nt, artificial
  Chemically synthesized
agcaacaucuaucugaaga

SEQ ID NO: 6116 - RNA, 19 nt, artificial
  Chemically synthesized
gaguuucaaagguugcugu

SEQ ID NO: 6117 - RNA, 19 nt, artificial
  Chemically synthesized
gguguuauuaccaugaguu

SEQ ID NO: 6118 - RNA, 19 nt, artificial
  Chemically synthesized
ugcagaagguggagaagac

SEQ ID NO: 6119 - RNA, 19 nt, artificial
  Chemically synthesized
cugcagaagguggagaaga

SEQ ID NO: 6120 - RNA, 19 nt, artificial
  Chemically synthesized
gaaucucuuuagggagaca

SEQ ID NO: 6121 - RNA, 19 nt, artificial
  Chemically synthesized
gccuucacuacagagacuu

SEQ ID NO: 6122 - RNA, 19 nt, artificial
  Chemically synthesized
gaguauacauugcuguuuc

SEQ ID NO: 6123 - RNA, 19 nt, artificial
  Chemically synthesized
gcauuucaaccaacucagu

SEQ ID NO: 6124 - RNA, 19 nt, artificial
  Chemically synthesized
cugguaucaucuucauugu

SEQ ID NO: 6125 - RNA, 19 nt, artificial
  Chemically synthesized
ugucucauguacuagugaa

SEQ ID NO: 6126 - RNA, 19 nt, artificial
  Chemically synthesized
agauaugcagggcugcuaa

SEQ ID NO: 6127 - RNA, 19 nt, artificial
  Chemically synthesized
gaugaguucucuacucuug

SEQ ID NO: 6128 - RNA, 19 nt, artificial
  Chemically synthesized
uauagaagagagugugauu

SEQ ID NO: 6129 - RNA, 19 nt, artificial
  Chemically synthesized
ugaacuggguguucacuuu

SEQ ID NO: 6130 - RNA, 19 nt, artificial
  Chemically synthesized
gguauucaaggcagggagu

SEQ ID NO: 6131 - RNA, 19 nt, artificial
  Chemically synthesized
gggugaguaauuccauggu

SEQ ID NO: 6132 - RNA, 19 nt, artificial
  Chemically synthesized
cagaguuuccugcaaugga

SEQ ID NO: 6133 - RNA, 19 nt, artificial
  Chemically synthesized
cuuagaacaacuagaacau

SEQ ID NO: 6134 - RNA, 19 nt, artificial
  Chemically synthesized
uucuagaucucaguagaaa

SEQ ID NO: 6135 - RNA, 19 nt, artificial
  Chemically synthesized
uuucuagaucucaguagaa

SEQ ID NO: 6136 - RNA, 19 nt, artificial
  Chemically synthesized
ccaugaguucaaacuucuu

SEQ ID NO: 6137 - RNA, 19 nt, artificial
  Chemically synthesized
ggugaaaacaucuaugaug

SEQ ID NO: 6138 - RNA, 19 nt, artificial
  Chemically synthesized
cuugugaacaccagaguuu

SEQ ID NO: 6139 - RNA, 19 nt, artificial
  Chemically synthesized
cuaagggugaguaauucca

SEQ ID NO: 6140 - RNA, 19 nt, artificial
  Chemically synthesized
caaccauccuggucauucu

SEQ ID NO: 6141 - RNA, 19 nt, artificial
  Chemically synthesized
uguggagacaaaucuagca

SEQ ID NO: 6142 - RNA, 19 nt, artificial
  Chemically synthesized
aguugaauaaagacagaga

SEQ ID NO: 6143 - RNA, 19 nt, artificial
  Chemically synthesized
acaccagaguugcuuucaa

SEQ ID NO: 6144 - RNA, 19 nt, artificial
  Chemically synthesized
agaguugcuuucaauggca

SEQ ID NO: 6145 - RNA, 19 nt, artificial
  Chemically synthesized
gcaugccugugcugaguuu

SEQ ID NO: 6146 - RNA, 19 nt, artificial
  Chemically synthesized
cuuaccucaucaaguugaa

SEQ ID NO: 6147 - RNA, 19 nt, artificial
  Chemically synthesized
gaguuugaauaucaccugu

SEQ ID NO: 6148 - RNA, 19 nt, artificial
  Chemically synthesized
aaguagucuagcuuucuua

SEQ ID NO: 6149 - RNA, 19 nt, artificial
  Chemically synthesized
aggugugaaauccagacaa

SEQ ID NO: 6150 - RNA, 19 nt, artificial
  Chemically synthesized
cuggguaaggaaugagcua

SEQ ID NO: 6151 - RNA, 19 nt, artificial
  Chemically synthesized
cuuacuuucacuuccaaca

SEQ ID NO: 6152 - RNA, 19 nt, artificial
  Chemically synthesized
gcucagaccuggcaguuuc

SEQ ID NO: 6153 - RNA, 19 nt, artificial
  Chemically synthesized
cauugaaacucaaaucucu

SEQ ID NO: 6154 - RNA, 19 nt, artificial
  Chemically synthesized
cacuauuuuucaaggaagu

SEQ ID NO: 6155 - RNA, 19 nt, artificial
  Chemically synthesized
ggcagcucuugguggaagu

SEQ ID NO: 6156 - RNA, 19 nt, artificial
  Chemically synthesized
cacccuuuagcccagaacu

SEQ ID NO: 6157 - RNA, 19 nt, artificial
  Chemically synthesized
cugucaugaaagcagcauu

SEQ ID NO: 6158 - RNA, 19 nt, artificial
  Chemically synthesized
uuguagcaguucuggucua

SEQ ID NO: 6159 - RNA, 19 nt, artificial
  Chemically synthesized
accacagucagaaguguuu

SEQ ID NO: 6160 - RNA, 19 nt, artificial
  Chemically synthesized
gcauuuaacucacucucca

SEQ ID NO: 6161 - RNA, 19 nt, artificial
  Chemically synthesized
ccuuauaagugucugaacu

SEQ ID NO: 6162 - RNA, 19 nt, artificial
  Chemically synthesized
caguagaaauggcuugagu

SEQ ID NO: 6163 - RNA, 19 nt, artificial
  Chemically synthesized
aggcuuacuuucacuucca

SEQ ID NO: 6164 - RNA, 19 nt, artificial
  Chemically synthesized
guaucaucuucauuguccu

SEQ ID NO: 6165 - RNA, 19 nt, artificial
  Chemically synthesized
gucagaugaauaagaccau

SEQ ID NO: 6166 - RNA, 19 nt, artificial
  Chemically synthesized
guccaacacuuguucaguu

SEQ ID NO: 6167 - RNA, 19 nt, artificial
  Chemically synthesized
caacaaaauucaguuguca

SEQ ID NO: 6168 - RNA, 19 nt, artificial
  Chemically synthesized
agcccagaacugcuuugaa

SEQ ID NO: 6169 - RNA, 19 nt, artificial
  Chemically synthesized
cucacaccagaguugcuuu

SEQ ID NO: 6170 - RNA, 19 nt, artificial
  Chemically synthesized
cugguggcuguggagacaa

SEQ ID NO: 6171 - RNA, 19 nt, artificial
  Chemically synthesized
cucagaaacugcucgguca

SEQ ID NO: 6172 - RNA, 19 nt, artificial
  Chemically synthesized
ggguguguuuccaugucuc

SEQ ID NO: 6173 - RNA, 19 nt, artificial
  Chemically synthesized
gucaaaacuggaaauauga

SEQ ID NO: 6174 - RNA, 19 nt, artificial
  Chemically synthesized
ucuugauuccagaaacaua

SEQ ID NO: 6175 - RNA, 19 nt, artificial
  Chemically synthesized
guucugggagaauuuagaa

SEQ ID NO: 6176 - RNA, 19 nt, artificial
  Chemically synthesized
agcccugcuggaugguaaa

SEQ ID NO: 6177 - RNA, 19 nt, artificial
  Chemically synthesized
cuccugugacaaaagagau

SEQ ID NO: 6178 - RNA, 19 nt, artificial
  Chemically synthesized
aguucuauuuucaccugau

SEQ ID NO: 6179 - RNA, 19 nt, artificial
  Chemically synthesized
ggaggaagggagaaaugag

SEQ ID NO: 6180 - RNA, 19 nt, artificial
  Chemically synthesized
uacuuucacuuccaacaaa

SEQ ID NO: 6181 - RNA, 19 nt, artificial
  Chemically synthesized
cugaaucucuuuagggaga

SEQ ID NO: 6182 - RNA, 19 nt, artificial
  Chemically synthesized
gcuuguccagucucgaagu

SEQ ID NO: 6183 - RNA, 19 nt, artificial
  Chemically synthesized
gagugaguuuucaguauuc

SEQ ID NO: 6184 - RNA, 19 nt, artificial
  Chemically synthesized
gugcaauuugaccauugaa

SEQ ID NO: 6185 - RNA, 19 nt, artificial
  Chemically synthesized
ugaaauccagacaauugaa

SEQ ID NO: 6186 - RNA, 19 nt, artificial
  Chemically synthesized
ugguggaaguugaacgaau

SEQ ID NO: 6187 - RNA, 19 nt, artificial
  Chemically synthesized
cauuucaacucuuaccuca

SEQ ID NO: 6188 - RNA, 19 nt, artificial
  Chemically synthesized
caccucucuaccuuaauau

SEQ ID NO: 6189 - RNA, 19 nt, artificial
  Chemically synthesized
agacaccagugccucagaa

SEQ ID NO: 6190 - RNA, 19 nt, artificial
  Chemically synthesized
ggugauagcgagccacgca

SEQ ID NO: 6191 - RNA, 19 nt, artificial
  Chemically synthesized
ccugcguggaggugugaaa

SEQ ID NO: 6192 - RNA, 19 nt, artificial
  Chemically synthesized
cucugaaucucuuuaggga

SEQ ID NO: 6193 - RNA, 19 nt, artificial
  Chemically synthesized
auagaagagagugugauua

SEQ ID NO: 6194 - RNA, 19 nt, artificial
  Chemically synthesized
caucuaugaugccuuuguu

SEQ ID NO: 6195 - RNA, 19 nt, artificial
  Chemically synthesized
guggagacaaaucuagcau

SEQ ID NO: 6196 - RNA, 19 nt, artificial
  Chemically synthesized
ccgcaugaucauaucugua

SEQ ID NO: 6197 - RNA, 19 nt, artificial
  Chemically synthesized
caguugucaaaacuggaaa

SEQ ID NO: 6198 - RNA, 19 nt, artificial
  Chemically synthesized
uucacuacagagacuuuau

SEQ ID NO: 6199 - RNA, 19 nt, artificial
  Chemically synthesized
uccugugacaaaagagaua

SEQ ID NO: 6200 - RNA, 19 nt, artificial
  Chemically synthesized
aacuuaauguggcucacaa

SEQ ID NO: 6201 - RNA, 19 nt, artificial
  Chemically synthesized
agaaagagacauuguucuu

SEQ ID NO: 6202 - RNA, 19 nt, artificial
  Chemically synthesized
cuauggcuguuugagauga

SEQ ID NO: 6203 - RNA, 19 nt, artificial
  Chemically synthesized
cucuacucuugugcuugua

SEQ ID NO: 6204 - RNA, 19 nt, artificial
  Chemically synthesized
gcagcauugaaauaauuug

SEQ ID NO: 6205 - RNA, 19 nt, artificial
  Chemically synthesized
aaaguaugguagaggugaa

SEQ ID NO: 6206 - RNA, 19 nt, artificial
  Chemically synthesized
gggagccuuuucuggacua

SEQ ID NO: 6207 - RNA, 19 nt, artificial
  Chemically synthesized
acuuaauguggcucacaau

SEQ ID NO: 6208 - RNA, 19 nt, artificial
  Chemically synthesized
caggaugaggacuggguaa

SEQ ID NO: 6209 - RNA, 19 nt, artificial
  Chemically synthesized
uuaugcuaagggugaguaa

SEQ ID NO: 6210 - RNA, 19 nt, artificial
  Chemically synthesized
cugguguaucuuugaauau

SEQ ID NO: 6211 - RNA, 19 nt, artificial
  Chemically synthesized
acuacuaccucgaugauau

SEQ ID NO: 6212 - RNA, 19 nt, artificial
  Chemically synthesized
gccaccucucuaccuuaau

SEQ ID NO: 6213 - RNA, 19 nt, artificial
  Chemically synthesized
ccugaacccuaugaacuuu

SEQ ID NO: 6214 - RNA, 19 nt, artificial
  Chemically synthesized
uaugcuaagggugaguaau

SEQ ID NO: 6215 - RNA, 19 nt, artificial
  Chemically synthesized
ggauacguuuccuuauaag

SEQ ID NO: 6216 - RNA, 19 nt, artificial
  Chemically synthesized
accaagccuugaguuucua

SEQ ID NO: 6217 - RNA, 19 nt, artificial
  Chemically synthesized
cauugagaaaacaaugugu

SEQ ID NO: 6218 - RNA, 19 nt, artificial
  Chemically synthesized
uguagcaguucuggucuau

SEQ ID NO: 6219 - RNA, 19 nt, artificial
  Chemically synthesized
gucuucagguacuaaauau

SEQ ID NO: 6220 - RNA, 19 nt, artificial
  Chemically synthesized
uagcaucucuagagaacuu

SEQ ID NO: 6221 - RNA, 19 nt, artificial
  Chemically synthesized
guguguccgcaugaucaua

SEQ ID NO: 6222 - RNA, 19 nt, artificial
  Chemically synthesized
ucuugauuacagucucaau

SEQ ID NO: 6223 - RNA, 19 nt, artificial
  Chemically synthesized
guguguguccgcaugauca

SEQ ID NO: 6224 - RNA, 19 nt, artificial
  Chemically synthesized
ccaugacaaagaaagucau

SEQ ID NO: 6225 - RNA, 19 nt, artificial
  Chemically synthesized
ccuacuaaguaaugacugu

SEQ ID NO: 6226 - RNA, 19 nt, artificial
  Chemically synthesized
agaugaauaagaccaucau

SEQ ID NO: 6227 - RNA, 19 nt, artificial
  Chemically synthesized
ggugggcauuucaaccaac

SEQ ID NO: 6228 - RNA, 19 nt, artificial
  Chemically synthesized
caggugcauuuaaagaaau

SEQ ID NO: 6229 - RNA, 19 nt, artificial
  Chemically synthesized
gagacuuuauucccggugu

SEQ ID NO: 6230 - RNA, 19 nt, artificial
  Chemically synthesized
gacauuucucauacucaca

SEQ ID NO: 6231 - RNA, 19 nt, artificial
  Chemically synthesized
gaaugagcuaguaaagaau

SEQ ID NO: 6232 - RNA, 19 nt, artificial
  Chemically synthesized
ccuugaguuucuagaucuc

SEQ ID NO: 6233 - RNA, 19 nt, artificial
  Chemically synthesized
ucuggagacgacucagaaa

SEQ ID NO: 6234 - RNA, 19 nt, artificial
  Chemically synthesized
agcugagaaacuugaccuu

SEQ ID NO: 6235 - RNA, 19 nt, artificial
  Chemically synthesized
agaagacaccagugccuca

SEQ ID NO: 6236 - RNA, 19 nt, artificial
  Chemically synthesized
ugaguuuucaguauuccua

SEQ ID NO: 6237 - RNA, 19 nt, artificial
  Chemically synthesized
cuccagucuucagguacua

SEQ ID NO: 6238 - RNA, 19 nt, artificial
  Chemically synthesized
ucaaggucuggcugguuua

SEQ ID NO: 6239 - RNA, 19 nt, artificial
  Chemically synthesized
cuuaugcuaagggugagua

SEQ ID NO: 6240 - RNA, 19 nt, artificial
  Chemically synthesized
agaacauucaagaaaagga

SEQ ID NO: 6241 - RNA, 19 nt, artificial
  Chemically synthesized
cccagaaaagaauguucau

SEQ ID NO: 6242 - RNA, 19 nt, artificial
  Chemically synthesized
cuuccaggugggcauuuca

SEQ ID NO: 6243 - RNA, 19 nt, artificial
  Chemically synthesized
ccuugacauuucucauacu

SEQ ID NO: 6244 - RNA, 19 nt, artificial
  Chemically synthesized
uacagucucaaucacauaa

SEQ ID NO: 6245 - RNA, 19 nt, artificial
  Chemically synthesized
guugcuguucucaaaguga

SEQ ID NO: 6246 - RNA, 19 nt, artificial
  Chemically synthesized
ggcauuucaaccaacucag

SEQ ID NO: 6247 - RNA, 19 nt, artificial
  Chemically synthesized
cgaggaagagaagacacca

SEQ ID NO: 6248 - RNA, 19 nt, artificial
  Chemically synthesized
ggaaaaguacacucuguca

SEQ ID NO: 6249 - RNA, 19 nt, artificial
  Chemically synthesized
caucuaucugaagaggaaa

SEQ ID NO: 6250 - RNA, 19 nt, artificial
  Chemically synthesized
gcuguggagacaaaucuag

SEQ ID NO: 6251 - RNA, 19 nt, artificial
  Chemically synthesized
cagucucaaucacauaaug

SEQ ID NO: 6252 - RNA, 19 nt, artificial
  Chemically synthesized
uagaagagagugugauuau

SEQ ID NO: 6253 - RNA, 19 nt, artificial
  Chemically synthesized
uguauagaagagaguguga

SEQ ID NO: 6254 - RNA, 19 nt, artificial
  Chemically synthesized
ccuuaugcuaagggugagu

SEQ ID NO: 6255 - RNA, 19 nt, artificial
  Chemically synthesized
cugccaacaucauccauga

SEQ ID NO: 6256 - RNA, 19 nt, artificial
  Chemically synthesized
cuaucagggcuguguguau

SEQ ID NO: 6257 - RNA, 19 nt, artificial
  Chemically synthesized
gaguugcuuucaauggcau

SEQ ID NO: 6258 - RNA, 19 nt, artificial
  Chemically synthesized
cuggucuauaaguucuauu

SEQ ID NO: 6259 - RNA, 19 nt, artificial
  Chemically synthesized
aguaucuguuguagcaguu

SEQ ID NO: 6260 - RNA, 19 nt, artificial
  Chemically synthesized
cugugcugaguuugaauau

SEQ ID NO: 6261 - RNA, 19 nt, artificial
  Chemically synthesized
caguauuccuaucacucag

SEQ ID NO: 6262 - RNA, 19 nt, artificial
  Chemically synthesized
ccauccuggucauucucga

SEQ ID NO: 6263 - RNA, 19 nt, artificial
  Chemically synthesized
ggucauucucgagcauguu

SEQ ID NO: 6264 - RNA, 19 nt, artificial
  Chemically synthesized
cagaguguguuugguuuga

SEQ ID NO: 6265 - RNA, 19 nt, artificial
  Chemically synthesized
gaguguuucagaguguguu

SEQ ID NO: 6266 - RNA, 19 nt, artificial
  Chemically synthesized
agaagacccugcucaggca

SEQ ID NO: 6267 - RNA, 19 nt, artificial
  Chemically synthesized
ugggaaugcuuuuucagaa

SEQ ID NO: 6268 - RNA, 19 nt, artificial
  Chemically synthesized
gggugaccucaugaaauga

SEQ ID NO: 6269 - RNA, 19 nt, artificial
  Chemically synthesized
gcucgaggaagagaagaca

SEQ ID NO: 6270 - RNA, 19 nt, artificial
  Chemically synthesized
auuucaaccaacucaguca

SEQ ID NO: 6271 - RNA, 19 nt, artificial
  Chemically synthesized
ucuucacagagcugagaaa

SEQ ID NO: 6272 - RNA, 19 nt, artificial
  Chemically synthesized
gaggugaaaacaucuauga

SEQ ID NO: 6273 - RNA, 19 nt, artificial
  Chemically synthesized
gguuuccauaaaagccgaa

SEQ ID NO: 6274 - RNA, 19 nt, artificial
  Chemically synthesized
cucagaccuggcaguuucu

SEQ ID NO: 6275 - RNA, 19 nt, artificial
  Chemically synthesized
cagaaagagacauuguucu

SEQ ID NO: 6276 - RNA, 19 nt, artificial
  Chemically synthesized
gagcuucaaugguguuauu

SEQ ID NO: 6277 - RNA, 19 nt, artificial
  Chemically synthesized
gagacauuguucuuuuccu

SEQ ID NO: 6278 - RNA, 19 nt, artificial
  Chemically synthesized
aagccuugaguuucuagau

SEQ ID NO: 6279 - RNA, 19 nt, artificial
  Chemically synthesized
agaaaagaauguucaucca

SEQ ID NO: 6280 - RNA, 19 nt, artificial
  Chemically synthesized
ugggcuuagaacaacuaga

SEQ ID NO: 6281 - RNA, 19 nt, artificial
  Chemically synthesized
gccugugcaauuugaccau

SEQ ID NO: 6282 - RNA, 19 nt, artificial
  Chemically synthesized
cagaugaauaagaccauca

SEQ ID NO: 6283 - RNA, 19 nt, artificial
  Chemically synthesized
cuuugucacucgaugucau

SEQ ID NO: 6284 - RNA, 19 nt, artificial
  Chemically synthesized
ccagaaacauaugggcuga

SEQ ID NO: 6285 - RNA, 19 nt, artificial
  Chemically synthesized
uagccaucauaaaaccauu

SEQ ID NO: 6286 - RNA, 19 nt, artificial
  Chemically synthesized
ccuuuucuugauuccagaa

SEQ ID NO: 6287 - RNA, 19 nt, artificial
  Chemically synthesized
agucucgaagucuugaaaa

SEQ ID NO: 6288 - RNA, 19 nt, artificial
  Chemically synthesized
guauagaagagagugugau

SEQ ID NO: 6289 - RNA, 19 nt, artificial
  Chemically synthesized
gaaacuuggaaaaguuuga

SEQ ID NO: 6290 - RNA, 19 nt, artificial
  Chemically synthesized
aucucuuuagggagacaca

SEQ ID NO: 6291 - RNA, 19 nt, artificial
  Chemically synthesized
uaaggaaugagcuaguaaa

SEQ ID NO: 6292 - RNA, 19 nt, artificial
  Chemically synthesized
uccugcagaagguggagaa

SEQ ID NO: 6293 - RNA, 19 nt, artificial
  Chemically synthesized
gucuagcuuucuuaaaucu

SEQ ID NO: 6294 - RNA, 19 nt, artificial
  Chemically synthesized
uggcuuguccagucucgaa

SEQ ID NO: 6295 - RNA, 19 nt, artificial
  Chemically synthesized
aguguuuguuacugagugu

SEQ ID NO: 6296 - RNA, 19 nt, artificial
  Chemically synthesized
cucauuuaccuugacauuu

SEQ ID NO: 6297 - RNA, 19 nt, artificial
  Chemically synthesized
guucucuacucuugugcuu

SEQ ID NO: 6298 - RNA, 19 nt, artificial
  Chemically synthesized
gccuuaugcuaagggugag

SEQ ID NO: 6299 - RNA, 19 nt, artificial
  Chemically synthesized
gucuagggugauugaacau

SEQ ID NO: 6300 - RNA, 19 nt, artificial
  Chemically synthesized
ugucugaaugaagcuauaa

SEQ ID NO: 6301 - RNA, 19 nt, artificial
  Chemically synthesized
cuuccagugcagagggaau

SEQ ID NO: 6302 - RNA, 19 nt, artificial
  Chemically synthesized
guacuaaauaugagccaca

SEQ ID NO: 6303 - RNA, 19 nt, artificial
  Chemically synthesized
cagaacugcuuugaauaca

SEQ ID NO: 6304 - RNA, 19 nt, artificial
  Chemically synthesized
cuugaguuucuagaucuca

SEQ ID NO: 6305 - RNA, 19 nt, artificial
  Chemically synthesized
aguugcagcagaaguuuau

SEQ ID NO: 6306 - RNA, 19 nt, artificial
  Chemically synthesized
cugcuuugaauacaccaau

SEQ ID NO: 6307 - RNA, 19 nt, artificial
  Chemically synthesized
cuuccaacaaaggugggaa

SEQ ID NO: 6308 - RNA, 19 nt, artificial
  Chemically synthesized
caaggcagggaguauacau

SEQ ID NO: 6309 - RNA, 19 nt, artificial
  Chemically synthesized
uccaugaagguuuccauaa

SEQ ID NO: 6310 - RNA, 19 nt, artificial
  Chemically synthesized
gcuguucucaaagugauuu

SEQ ID NO: 6311 - RNA, 19 nt, artificial
  Chemically synthesized
aucugaccaaucuagagca

SEQ ID NO: 6312 - RNA, 19 nt, artificial
  Chemically synthesized
cuaucacucagaaaccuca

SEQ ID NO: 6313 - RNA, 19 nt, artificial
  Chemically synthesized
guggcuguggagacaaauc

SEQ ID NO: 6314 - RNA, 19 nt, artificial
  Chemically synthesized
auuacagucucaaucacau

SEQ ID NO: 6315 - RNA, 19 nt, artificial
  Chemically synthesized
ugaagaauuccgauuagca

SEQ ID NO: 6316 - RNA, 19 nt, artificial
  Chemically synthesized
ggaacuacagcauuuucca

SEQ ID NO: 6317 - RNA, 19 nt, artificial
  Chemically synthesized
caaacuucuugggcuuaga

SEQ ID NO: 6318 - RNA, 19 nt, artificial
  Chemically synthesized
guggagaagacccugcuca

SEQ ID NO: 6319 - RNA, 19 nt, artificial
  Chemically synthesized
agguuuccauaaaagccga

SEQ ID NO: 6320 - RNA, 19 nt, artificial
  Chemically synthesized
ugccuauaagcuaauauca

SEQ ID NO: 6321 - RNA, 19 nt, artificial
  Chemically synthesized
cuacucuugugcuuguaca

SEQ ID NO: 6322 - RNA, 19 nt, artificial
  Chemically synthesized
gaauaaagacagagaaaac

SEQ ID NO: 6323 - RNA, 19 nt, artificial
  Chemically synthesized
ggacucugaucccagccau

SEQ ID NO: 6324 - RNA, 19 nt, artificial
  Chemically synthesized
cuggagcaguugucuccaa

SEQ ID NO: 6325 - RNA, 19 nt, artificial
  Chemically synthesized
gugcuucaaauauccauau

SEQ ID NO: 6326 - RNA, 19 nt, artificial
  Chemically synthesized
aggacuggguaaggaauga

SEQ ID NO: 6327 - RNA, 19 nt, artificial
  Chemically synthesized
gaccugucccugaacccua

SEQ ID NO: 6328 - RNA, 19 nt, artificial
  Chemically synthesized
augaguugcagcagaaguu

SEQ ID NO: 6329 - RNA, 19 nt, artificial
  Chemically synthesized
acaccagaguuuccugcaa

SEQ ID NO: 6330 - RNA, 19 nt, artificial
  Chemically synthesized
cacagucagaaguguuugu

SEQ ID NO: 6331 - RNA, 19 nt, artificial
  Chemically synthesized
ugcuguuucuuuagccacu

SEQ ID NO: 6332 - RNA, 19 nt, artificial
  Chemically synthesized
gagagugugauuauauuuc

SEQ ID NO: 6333 - RNA, 19 nt, artificial
  Chemically synthesized
ucaguauuccuaucacuca

SEQ ID NO: 6334 - RNA, 19 nt, artificial
  Chemically synthesized
cagaaguguuuguuacuga

SEQ ID NO: 6335 - RNA, 19 nt, artificial
  Chemically synthesized
uggcuguuugagaugaguu

SEQ ID NO: 6336 - RNA, 19 nt, artificial
  Chemically synthesized
gaaagucauuucaacucuu

SEQ ID NO: 6337 - RNA, 19 nt, artificial
  Chemically synthesized
ccuccucagaaacagaaca

SEQ ID NO: 6338 - RNA, 19 nt, artificial
  Chemically synthesized
cauaaaagccgaaagguga

SEQ ID NO: 6339 - RNA, 19 nt, artificial
  Chemically synthesized
cuauugaaaggguaaaaga

SEQ ID NO: 6340 - RNA, 19 nt, artificial
  Chemically synthesized
guauuccuaucacucagaa

SEQ ID NO: 6341 - RNA, 19 nt, artificial
  Chemically synthesized
acucuuaccucaucaaguu

SEQ ID NO: 6342 - RNA, 19 nt, artificial
  Chemically synthesized
aaguaaugacugucaugaa

SEQ ID NO: 6343 - RNA, 19 nt, artificial
  Chemically synthesized
cuuauaauuucggauggca

SEQ ID NO: 6344 - RNA, 19 nt, artificial
  Chemically synthesized
ugaguaauuccauggugca

SEQ ID NO: 6345 - RNA, 19 nt, artificial
  Chemically synthesized
ccuuuguuaucuacucaag

SEQ ID NO: 6346 - RNA, 19 nt, artificial
  Chemically synthesized
aacuacgugugaagguauu

SEQ ID NO: 6347 - RNA, 19 nt, artificial
  Chemically synthesized
gggagaaaugaggaaauag

SEQ ID NO: 6348 - RNA, 19 nt, artificial
  Chemically synthesized
gccuaagccaccucucuac

SEQ ID NO: 6349 - RNA, 19 nt, artificial
  Chemically synthesized
ugaggacuggguaaggaau

SEQ ID NO: 6350 - RNA, 19 nt, artificial
  Chemically synthesized
agguugcuguucucaaagu

SEQ ID NO: 6351 - RNA, 19 nt, artificial
  Chemically synthesized
cugcuaaucucaaggagcu

SEQ ID NO: 6352 - RNA, 19 nt, artificial
  Chemically synthesized
cccaugacaaagaaaguca

SEQ ID NO: 6353 - RNA, 19 nt, artificial
  Chemically synthesized
uucuaaucugaccaaucua

SEQ ID NO: 6354 - RNA, 19 nt, artificial
  Chemically synthesized
cugucacuuugucacucga

SEQ ID NO: 6355 - RNA, 19 nt, artificial
  Chemically synthesized
gcuuucaauggcaucuuca

SEQ ID NO: 6356 - RNA, 19 nt, artificial
  Chemically synthesized
caacacuuguucaguuaau

SEQ ID NO: 6357 - RNA, 19 nt, artificial
  Chemically synthesized
cauucaagaaaaggacaau

SEQ ID NO: 6358 - RNA, 19 nt, artificial
  Chemically synthesized
gguuaaagucuaguggcua

SEQ ID NO: 6359 - RNA, 19 nt, artificial
  Chemically synthesized
cauuuaccuugacauuucu

SEQ ID NO: 6360 - RNA, 19 nt, artificial
  Chemically synthesized
cagaccuggcaguuucuga

SEQ ID NO: 6361 - RNA, 19 nt, artificial
  Chemically synthesized
ggaagaaaauuuccgcuuc

SEQ ID NO: 6362 - RNA, 19 nt, artificial
  Chemically synthesized
cagccuccucagaaacaga

SEQ ID NO: 6363 - RNA, 19 nt, artificial
  Chemically synthesized
cuugaaaauggcuggcaau

SEQ ID NO: 6364 - RNA, 19 nt, artificial
  Chemically synthesized
ggagaaaugaggaaauagg

SEQ ID NO: 6365 - RNA, 19 nt, artificial
  Chemically synthesized
gagcaggucuagggugauu

SEQ ID NO: 6366 - RNA, 19 nt, artificial
  Chemically synthesized
guguguguguccgcaugau

SEQ ID NO: 6367 - RNA, 19 nt, artificial
  Chemically synthesized
ccagaaggaacagugggua

SEQ ID NO: 6368 - RNA, 19 nt, artificial
  Chemically synthesized
gcuggguccaacacuuguu

SEQ ID NO: 6369 - RNA, 19 nt, artificial
  Chemically synthesized
ugugacuauugaaagggua

SEQ ID NO: 6370 - RNA, 19 nt, artificial
  Chemically synthesized
cacuacagagacuuuauuc

SEQ ID NO: 6371 - RNA, 19 nt, artificial
  Chemically synthesized
ucacuacagagacuuuauu

SEQ ID NO: 6372 - RNA, 19 nt, artificial
  Chemically synthesized
ggcucgaggaagagaagac

SEQ ID NO: 6373 - RNA, 19 nt, artificial
  Chemically synthesized
gcagggcugcuaaucucaa

SEQ ID NO: 6374 - RNA, 19 nt, artificial
  Chemically synthesized
auucaaggcagggaguaua

SEQ ID NO: 6375 - RNA, 19 nt, artificial
  Chemically synthesized
cagugcagagggaauaaau

SEQ ID NO: 6376 - RNA, 19 nt, artificial
  Chemically synthesized
caucuggauuuccagcauu

SEQ ID NO: 6377 - RNA, 19 nt, artificial
  Chemically synthesized
uaaagaagguucccagaaa

SEQ ID NO: 6378 - RNA, 19 nt, artificial
  Chemically synthesized
cgcaugaucauaucuguau

SEQ ID NO: 6379 - RNA, 19 nt, artificial
  Chemically synthesized
gugugucgguccucagugu

SEQ ID NO: 6380 - RNA, 19 nt, artificial
  Chemically synthesized
gggaagaaaauuuccgcuu

SEQ ID NO: 6381 - RNA, 19 nt, artificial
  Chemically synthesized
gggcugcuaaucucaagga

SEQ ID NO: 6382 - RNA, 19 nt, artificial
  Chemically synthesized
aggugaaaacaucuaugau

SEQ ID NO: 6383 - RNA, 19 nt, artificial
  Chemically synthesized
augagugaguuuucaguau

SEQ ID NO: 6384 - RNA, 19 nt, artificial
  Chemically synthesized
agccaucauaaaaccauuu

SEQ ID NO: 6385 - RNA, 19 nt, artificial
  Chemically synthesized
agcaguucuggucuauaag

SEQ ID NO: 6386 - RNA, 19 nt, artificial
  Chemically synthesized
uacgugugaagguauucaa

SEQ ID NO: 6387 - RNA, 19 nt, artificial
  Chemically synthesized
gauuaacacaugcucacaa

SEQ ID NO: 6388 - RNA, 19 nt, artificial
  Chemically synthesized
cucacaaucuuauccaauc

SEQ ID NO: 6389 - RNA, 19 nt, artificial
  Chemically synthesized
cucaguagaaauggcuuga

SEQ ID NO: 6390 - RNA, 19 nt, artificial
  Chemically synthesized
cacuuccucucacccuuua

SEQ ID NO: 6391 - RNA, 19 nt, artificial
  Chemically synthesized
gaaagagacauuguucuuu

SEQ ID NO: 6392 - RNA, 19 nt, artificial
  Chemically synthesized
gguagaggugaaaacaucu

SEQ ID NO: 6393 - RNA, 19 nt, artificial
  Chemically synthesized
ucacauaaugacuuccaaa

SEQ ID NO: 6394 - RNA, 19 nt, artificial
  Chemically synthesized
caggucuagggugauugaa

SEQ ID NO: 6395 - RNA, 19 nt, artificial
  Chemically synthesized
ucaugaaagcagcauugaa

SEQ ID NO: 6396 - RNA, 19 nt, artificial
  Chemically synthesized
accugucagaugaauaaga

SEQ ID NO: 6397 - RNA, 19 nt, artificial
  Chemically synthesized
gcaggaagcaacaucuauc

SEQ ID NO: 6398 - RNA, 19 nt, artificial
  Chemically synthesized
ccacuggucugcaggcguu

SEQ ID NO: 6399 - RNA, 19 nt, artificial
  Chemically synthesized
ccuggucuuaucauggaca

SEQ ID NO: 6400 - RNA, 19 nt, artificial
  Chemically synthesized
ugggaagaguggauguuau

SEQ ID NO: 6401 - RNA, 19 nt, artificial
  Chemically synthesized
gaaaguagaugugugcauu

SEQ ID NO: 6402 - RNA, 19 nt, artificial
  Chemically synthesized
gcuuccuggucuuaucaug

SEQ ID NO: 6403 - RNA, 19 nt, artificial
  Chemically synthesized
ggugaguaauuccauggug

SEQ ID NO: 6404 - RNA, 19 nt, artificial
  Chemically synthesized
ugagucuuuugaauggaaa

SEQ ID NO: 6405 - RNA, 19 nt, artificial
  Chemically synthesized
cucauguacuagugaaagu

SEQ ID NO: 6406 - RNA, 19 nt, artificial
  Chemically synthesized
caaucuuauccaaucuuuc

SEQ ID NO: 6407 - RNA, 19 nt, artificial
  Chemically synthesized
cccuacucaaucucucuuu

SEQ ID NO: 6408 - RNA, 19 nt, artificial
  Chemically synthesized
gaugucuauggcuguuuga

SEQ ID NO: 6409 - RNA, 19 nt, artificial
  Chemically synthesized
ccaugucucauguacuagu

SEQ ID NO: 6410 - RNA, 19 nt, artificial
  Chemically synthesized
ccaggagaacuacguguga

SEQ ID NO: 6411 - RNA, 19 nt, artificial
  Chemically synthesized
cuugcuguuucuuuagcca

SEQ ID NO: 6412 - RNA, 19 nt, artificial
  Chemically synthesized
ccuuuagcccagaacugcu

SEQ ID NO: 6413 - RNA, 19 nt, artificial
  Chemically synthesized
cccacauugaaacucaaau

SEQ ID NO: 6414 - RNA, 19 nt, artificial
  Chemically synthesized
gugaguuuucaguauuccu

SEQ ID NO: 6415 - RNA, 19 nt, artificial
  Chemically synthesized
uucagaaguugaucuacca

SEQ ID NO: 6416 - RNA, 19 nt, artificial
  Chemically synthesized
aucuaucugaagaggaaaa

SEQ ID NO: 6417 - RNA, 19 nt, artificial
  Chemically synthesized
cuacuaccucgaugauauu

SEQ ID NO: 6418 - RNA, 19 nt, artificial
  Chemically synthesized
ccaaguagucuagcuuucu

SEQ ID NO: 6419 - RNA, 19 nt, artificial
  Chemically synthesized
aaagacagagaaaacagaa

SEQ ID NO: 6420 - RNA, 19 nt, artificial
  Chemically synthesized
gcaucucuagagaacuucc

SEQ ID NO: 6421 - RNA, 19 nt, artificial
  Chemically synthesized
ccugugcaauuugaccauu

SEQ ID NO: 6422 - RNA, 19 nt, artificial
  Chemically synthesized
gugggcauuucaaccaacu

SEQ ID NO: 6423 - RNA, 19 nt, artificial
  Chemically synthesized
gccauugcugccaacauca

SEQ ID NO: 6424 - RNA, 19 nt, artificial
  Chemically synthesized
aaaucucucaaaaggcuua

SEQ ID NO: 6425 - RNA, 19 nt, artificial
  Chemically synthesized
uguuuaagacgugcuucaa

SEQ ID NO: 6426 - RNA, 19 nt, artificial
  Chemically synthesized
ccugaguauuuuucuaauc

SEQ ID NO: 6427 - RNA, 19 nt, artificial
  Chemically synthesized
ucuaccaagccuugaguuu

SEQ ID NO: 6428 - RNA, 19 nt, artificial
  Chemically synthesized
ugugcaauuugaccauuga

SEQ ID NO: 6429 - RNA, 19 nt, artificial
  Chemically synthesized
agaagguggagaagacccu

SEQ ID NO: 6430 - RNA, 19 nt, artificial
  Chemically synthesized
gccuuuucuggacuaucaa

SEQ ID NO: 6431 - RNA, 19 nt, artificial
  Chemically synthesized
gaaggaaacuuggaaaagu

SEQ ID NO: 6432 - RNA, 19 nt, artificial
  Chemically synthesized
aagcccugcuggaugguaa

SEQ ID NO: 6433 - RNA, 19 nt, artificial
  Chemically synthesized
cuucuaacuuccucuccug

SEQ ID NO: 6434 - RNA, 19 nt, artificial
  Chemically synthesized
accugucccugaacccuau

SEQ ID NO: 6435 - RNA, 19 nt, artificial
  Chemically synthesized
agaacaagugauguuugau

SEQ ID NO: 6436 - RNA, 19 nt, artificial
  Chemically synthesized
aguuucaaagguugcuguu

SEQ ID NO: 6437 - RNA, 19 nt, artificial
  Chemically synthesized
ggcacaucuucuggagacg

SEQ ID NO: 6438 - RNA, 19 nt, artificial
  Chemically synthesized
acugcuuugaauacaccaa

SEQ ID NO: 6439 - RNA, 19 nt, artificial
  Chemically synthesized
ggcuccugaugcaagaugc

SEQ ID NO: 6440 - RNA, 19 nt, artificial
  Chemically synthesized
gucuggcugguuuagaagu

SEQ ID NO: 6441 - RNA, 19 nt, artificial
  Chemically synthesized
aagggagaaaugaggaaau

SEQ ID NO: 6442 - RNA, 19 nt, artificial
  Chemically synthesized
cucuagagggccugugcaa

SEQ ID NO: 6443 - RNA, 19 nt, artificial
  Chemically synthesized
uaccaagccuugaguuucu

SEQ ID NO: 6444 - RNA, 19 nt, artificial
  Chemically synthesized
ucaucuucauuguccugca

SEQ ID NO: 6445 - RNA, 19 nt, artificial
  Chemically synthesized
gguugcuguucucaaagug

SEQ ID NO: 6446 - RNA, 19 nt, artificial
  Chemically synthesized
ugaguugcagcagaaguuu

SEQ ID NO: 6447 - RNA, 19 nt, artificial
  Chemically synthesized
ccgcuuccuggucuuauca

SEQ ID NO: 6448 - RNA, 19 nt, artificial
  Chemically synthesized
cgugcugguaucaucuuca

SEQ ID NO: 6449 - RNA, 19 nt, artificial
  Chemically synthesized
uggucauucucgagcaugu

SEQ ID NO: 6450 - RNA, 19 nt, artificial
  Chemically synthesized
cucaaaacuuugaaagaac

SEQ ID NO: 6451 - RNA, 19 nt, artificial
  Chemically synthesized
augcuaagguugccgcuuu

SEQ ID NO: 6452 - RNA, 19 nt, artificial
  Chemically synthesized
cucacugccaggagaacua

SEQ ID NO: 6453 - RNA, 19 nt, artificial
  Chemically synthesized
gucuccuuacagagguuaa

SEQ ID NO: 6454 - RNA, 19 nt, artificial
  Chemically synthesized
ugccuucacuacagagacu

SEQ ID NO: 6455 - RNA, 19 nt, artificial
  Chemically synthesized
gcuuccagugcagagggaa

SEQ ID NO: 6456 - RNA, 19 nt, artificial
  Chemically synthesized
gaucuaccaagccuugagu

SEQ ID NO: 6457 - RNA, 19 nt, artificial
  Chemically synthesized
guguucacuuuuuccuuuu

SEQ ID NO: 6458 - RNA, 19 nt, artificial
  Chemically synthesized
gucaaggaacccaugacaa

SEQ ID NO: 6459 - RNA, 19 nt, artificial
  Chemically synthesized
ugcucagaccuggcaguuu

SEQ ID NO: 6460 - RNA, 19 nt, artificial
  Chemically synthesized
gcaacaucuaucugaagag

SEQ ID NO: 6461 - RNA, 19 nt, artificial
  Chemically synthesized
gacuaaaauacagagucuu

SEQ ID NO: 6462 - RNA, 19 nt, artificial
  Chemically synthesized
gaucauaucuguauagaag

SEQ ID NO: 6463 - RNA, 19 nt, artificial
  Chemically synthesized
aucacauaaugacuuccaa

SEQ ID NO: 6464 - RNA, 19 nt, artificial
  Chemically synthesized
guugggcaaugcuccuuga

SEQ ID NO: 6465 - RNA, 19 nt, artificial
  Chemically synthesized
gguccaacacuuguucagu

SEQ ID NO: 6466 - RNA, 19 nt, artificial
  Chemically synthesized
guuuagcccugggagccuu

SEQ ID NO: 6467 - RNA, 19 nt, artificial
  Chemically synthesized
ugggagaauuuagaaauga

SEQ ID NO: 6468 - RNA, 19 nt, artificial
  Chemically synthesized
ggaagaguggauguuauca

SEQ ID NO: 6469 - RNA, 19 nt, artificial
  Chemically synthesized
ccucaucaaguugaauaaa

SEQ ID NO: 6470 - RNA, 19 nt, artificial
  Chemically synthesized
cugggagaauuuagaaaug

SEQ ID NO: 6471 - RNA, 19 nt, artificial
  Chemically synthesized
aaggaaguauggaaaagua

SEQ ID NO: 6472 - RNA, 19 nt, artificial
  Chemically synthesized
ggaccuuuccagcaacaag

SEQ ID NO: 6473 - RNA, 19 nt, artificial
  Chemically synthesized
gccuaaaguauuuagaucu

SEQ ID NO: 6474 - RNA, 19 nt, artificial
  Chemically synthesized
uuacagucucaaucacaua

SEQ ID NO: 6475 - RNA, 19 nt, artificial
  Chemically synthesized
aacagaaagagacauuguu

SEQ ID NO: 6476 - RNA, 19 nt, artificial
  Chemically synthesized
uggucuuaucauggacaau

SEQ ID NO: 6477 - RNA, 19 nt, artificial
  Chemically synthesized
gacaaagaaagucauuuca

SEQ ID NO: 6478 - RNA, 19 nt, artificial
  Chemically synthesized
ucagaaacagaacauucaa

SEQ ID NO: 6479 - RNA, 19 nt, artificial
  Chemically synthesized
cuggaaauaugaccacagu

SEQ ID NO: 6480 - RNA, 19 nt, artificial
  Chemically synthesized
agaaggaacaguggguaca

SEQ ID NO: 6481 - RNA, 19 nt, artificial
  Chemically synthesized
cauuguucuuuuccugagu

SEQ ID NO: 6482 - RNA, 19 nt, artificial
  Chemically synthesized
aguugucaaaacuggaaau

SEQ ID NO: 6483 - RNA, 19 nt, artificial
  Chemically synthesized
ccugcgugagaccagaaag

SEQ ID NO: 6484 - RNA, 19 nt, artificial
  Chemically synthesized
ugacaaaucugcucuagag

SEQ ID NO: 6485 - RNA, 19 nt, artificial
  Chemically synthesized
cuuuuaaacgggaagaaaa

SEQ ID NO: 6486 - RNA, 19 nt, artificial
  Chemically synthesized
agagaaaacagaaagagac

SEQ ID NO: 6487 - RNA, 19 nt, artificial
  Chemically synthesized
caguugucuccaacagcau

SEQ ID NO: 6488 - RNA, 19 nt, artificial
  Chemically synthesized
gugugacuauugaaagggu

SEQ ID NO: 6489 - RNA, 19 nt, artificial
  Chemically synthesized
ccuucucacugccaggaga

SEQ ID NO: 6490 - RNA, 19 nt, artificial
  Chemically synthesized
gggcaugccugugcugagu

SEQ ID NO: 6491 - RNA, 19 nt, artificial
  Chemically synthesized
gauaugcagggcugcuaau

SEQ ID NO: 6492 - RNA, 19 nt, artificial
  Chemically synthesized
aguugucuccaacagcauu

SEQ ID NO: 6493 - RNA, 19 nt, artificial
  Chemically synthesized
ugcacauaucccuauguau

SEQ ID NO: 6494 - RNA, 19 nt, artificial
  Chemically synthesized
ccucuccugugacaaaaga

SEQ ID NO: 6495 - RNA, 19 nt, artificial
  Chemically synthesized
uggauuuccagcauuccaa

SEQ ID NO: 6496 - RNA, 19 nt, artificial
  Chemically synthesized
guauucaaggcagggagua

SEQ ID NO: 6497 - RNA, 19 nt, artificial
  Chemically synthesized
caauuaugucugaaugaag

SEQ ID NO: 6498 - RNA, 19 nt, artificial
  Chemically synthesized
cucacccuuuagcccagaa

SEQ ID NO: 6499 - RNA, 19 nt, artificial
  Chemically synthesized
uuugguucugggagaauuu

SEQ ID NO: 6500 - RNA, 19 nt, artificial
  Chemically synthesized
ggccugugcaauuugacca

SEQ ID NO: 6501 - RNA, 19 nt, artificial
  Chemically synthesized
ggagccuuuucuggacuau

SEQ ID NO: 6502 - RNA, 19 nt, artificial
  Chemically synthesized
guugcagcagaaguuuauu

SEQ ID NO: 6503 - RNA, 19 nt, artificial
  Chemically synthesized
auccaugaagguuuccaua

SEQ ID NO: 6504 - RNA, 19 nt, artificial
  Chemically synthesized
uggcaauucuuuccaggaa

SEQ ID NO: 6505 - RNA, 19 nt, artificial
  Chemically synthesized
cugucuccuuacagagguu

SEQ ID NO: 6506 - RNA, 19 nt, artificial
  Chemically synthesized
gcucacaaucuuauccaau

SEQ ID NO: 6507 - RNA, 19 nt, artificial
  Chemically synthesized
ggcaguuucugagcagucg

SEQ ID NO: 6508 - RNA, 19 nt, artificial
  Chemically synthesized
gaaguugaacgaauggaau

SEQ ID NO: 6509 - RNA, 19 nt, artificial
  Chemically synthesized
aggucuagggugauugaac

SEQ ID NO: 6510 - RNA, 19 nt, artificial
  Chemically synthesized
caaaaggcuuacuuucacu

SEQ ID NO: 6511 - RNA, 19 nt, artificial
  Chemically synthesized
aaaacuuccuuccagauau

SEQ ID NO: 6512 - RNA, 19 nt, artificial
  Chemically synthesized
ccgcuuucacuuccucuca

SEQ ID NO: 6513 - RNA, 19 nt, artificial
  Chemically synthesized
gugugcuuguaguaucugu

SEQ ID NO: 6514 - RNA, 19 nt, artificial
  Chemically synthesized
aggaggaagggagaaauga

SEQ ID NO: 6515 - RNA, 19 nt, artificial
  Chemically synthesized
caacaaaggugggaaugcu

SEQ ID NO: 6516 - RNA, 19 nt, artificial
  Chemically synthesized
caucauccaugaagguuuc

SEQ ID NO: 6517 - RNA, 19 nt, artificial
  Chemically synthesized
cuuugaauaugagauugcu

SEQ ID NO: 6518 - RNA, 19 nt, artificial
  Chemically synthesized
auggaauccagaaggaaca

SEQ ID NO: 6519 - RNA, 19 nt, artificial
  Chemically synthesized
aacuagaacaucuggauuu

SEQ ID NO: 6520 - RNA, 19 nt, artificial
  Chemically synthesized
aaggcagggaguauacauu

SEQ ID NO: 6521 - RNA, 19 nt, artificial
  Chemically synthesized
caaaggugggaaugcuuuu

SEQ ID NO: 6522 - RNA, 19 nt, artificial
  Chemically synthesized
agugucaacuggagcaguu

SEQ ID NO: 6523 - RNA, 19 nt, artificial
  Chemically synthesized
aggaagagaagacaccagu

SEQ ID NO: 6524 - RNA, 19 nt, artificial
  Chemically synthesized
gaauaagaccaucauuggu

SEQ ID NO: 6525 - RNA, 19 nt, artificial
  Chemically synthesized
ccaaucuagagcacuugga

SEQ ID NO: 6526 - RNA, 19 nt, artificial
  Chemically synthesized
agaaaacagaaagagacau

SEQ ID NO: 6527 - RNA, 19 nt, artificial
  Chemically synthesized
cuucuggagacgacucaga

SEQ ID NO: 6528 - RNA, 19 nt, artificial
  Chemically synthesized
aguggguacaggaugcaau

SEQ ID NO: 6529 - RNA, 19 nt, artificial
  Chemically synthesized
agaagguucccagaaaaga

SEQ ID NO: 6530 - RNA, 19 nt, artificial
  Chemically synthesized
auaagguuguuuaagacgu

SEQ ID NO: 6531 - RNA, 19 nt, artificial
  Chemically synthesized
auaucaccugucagaugaa

SEQ ID NO: 6532 - RNA, 19 nt, artificial
  Chemically synthesized
ccacuauuuuucaaggaag

SEQ ID NO: 6533 - RNA, 19 nt, artificial
  Chemically synthesized
caauuggcaggaagcaaca

SEQ ID NO: 6534 - RNA, 19 nt, artificial
  Chemically synthesized
gcacaucuucuggagacga

SEQ ID NO: 6535 - RNA, 19 nt, artificial
  Chemically synthesized
ucugggagaauuuagaaau

SEQ ID NO: 6536 - RNA, 19 nt, artificial
  Chemically synthesized
uccucagugugcuuguagu

SEQ ID NO: 6537 - RNA, 19 nt, artificial
  Chemically synthesized
aggaacccaugacaaagaa

SEQ ID NO: 6538 - RNA, 19 nt, artificial
  Chemically synthesized
cuaaauaugagccacaaca

SEQ ID NO: 6539 - RNA, 19 nt, artificial
  Chemically synthesized
ccuuccuggaccucucuca

SEQ ID NO: 6540 - RNA, 19 nt, artificial
  Chemically synthesized
gaacuuaauguggcucaca

SEQ ID NO: 6541 - RNA, 19 nt, artificial
  Chemically synthesized
aaauggcuugaguuucaaa

SEQ ID NO: 6542 - RNA, 19 nt, artificial
  Chemically synthesized
agagaagacaccagugccu

SEQ ID NO: 6543 - RNA, 19 nt, artificial
  Chemically synthesized
uggagacaaaucuagcauc

SEQ ID NO: 6544 - RNA, 19 nt, artificial
  Chemically synthesized
cauacuuagacuacuaccu

SEQ ID NO: 6545 - RNA, 19 nt, artificial
  Chemically synthesized
auuccgauuagcauacuua

SEQ ID NO: 6546 - RNA, 19 nt, artificial
  Chemically synthesized
acagucucaaucacauaau

SEQ ID NO: 6547 - RNA, 19 nt, artificial
  Chemically synthesized
ugcaauggaucaaggacca

SEQ ID NO: 6548 - RNA, 19 nt, artificial
  Chemically synthesized
cuacgugugaagguauuca

SEQ ID NO: 6549 - RNA, 19 nt, artificial
  Chemically synthesized
agccuccucagaaacagaa

SEQ ID NO: 6550 - RNA, 19 nt, artificial
  Chemically synthesized
agugauguuugauggaccu

SEQ ID NO: 6551 - RNA, 19 nt, artificial
  Chemically synthesized
guagaggugaaaacaucua

SEQ ID NO: 6552 - RNA, 19 nt, artificial
  Chemically synthesized
gagaacuacgugugaaggu

SEQ ID NO: 6553 - RNA, 19 nt, artificial
  Chemically synthesized
gggcuagaggcaggaagga

SEQ ID NO: 6554 - RNA, 19 nt, artificial
  Chemically synthesized
gguuuagaaguccaucguu

SEQ ID NO: 6555 - RNA, 19 nt, artificial
  Chemically synthesized
auuggauacguuuccuuau

SEQ ID NO: 6556 - RNA, 19 nt, artificial
  Chemically synthesized
uggcuugaguuucaaaggu

SEQ ID NO: 6557 - RNA, 19 nt, artificial
  Chemically synthesized
gaaagaacuuaauguggcu

SEQ ID NO: 6558 - RNA, 19 nt, artificial
  Chemically synthesized
aaggaaacuuggaaaaguu

SEQ ID NO: 6559 - RNA, 19 nt, artificial
  Chemically synthesized
accaggugcauuuaaagaa

SEQ ID NO: 6560 - RNA, 19 nt, artificial
  Chemically synthesized
ugucagaugaauaagacca

SEQ ID NO: 6561 - RNA, 19 nt, artificial
  Chemically synthesized
gaaugcuuuuucagaaguu

SEQ ID NO: 6562 - RNA, 19 nt, artificial
  Chemically synthesized
ugcuaagggugaguaauuc

SEQ ID NO: 6563 - RNA, 19 nt, artificial
  Chemically synthesized
caugaaaugaguugcagca

SEQ ID NO: 6564 - RNA, 19 nt, artificial
  Chemically synthesized
gugcugguaucaucuucau

SEQ ID NO: 6565 - RNA, 19 nt, artificial
  Chemically synthesized
uguuuguuacugaguguuu

SEQ ID NO: 6566 - RNA, 19 nt, artificial
  Chemically synthesized
uggcuguggagacaaaucu

SEQ ID NO: 6567 - RNA, 19 nt, artificial
  Chemically synthesized
ucgagcauguucuauuuuu

SEQ ID NO: 6568 - RNA, 19 nt, artificial
  Chemically synthesized
gcgugagaccagaaagcug

SEQ ID NO: 6569 - RNA, 19 nt, artificial
  Chemically synthesized
ccagaaagcugggagcccu

SEQ ID NO: 6570 - RNA, 19 nt, artificial
  Chemically synthesized
cuguucucaaagugauuuu

SEQ ID NO: 6571 - RNA, 19 nt, artificial
  Chemically synthesized
cucuaccuuaauauugaca

SEQ ID NO: 6572 - RNA, 19 nt, artificial
  Chemically synthesized
ccucucuaccuuaauauug

SEQ ID NO: 6573 - RNA, 19 nt, artificial
  Chemically synthesized
cuaccaagccuugaguuuc

SEQ ID NO: 6574 - RNA, 19 nt, artificial
  Chemically synthesized
aggagaacuacgugugaag

SEQ ID NO: 6575 - RNA, 19 nt, artificial
  Chemically synthesized
gucagaaguguuuguuacu

SEQ ID NO: 6576 - RNA, 19 nt, artificial
  Chemically synthesized
ccauccagaguuuagcccu

SEQ ID NO: 6577 - RNA, 19 nt, artificial
  Chemically synthesized
auuucggauggcaacauuu

SEQ ID NO: 6578 - RNA, 19 nt, artificial
  Chemically synthesized
ugagaugaguucucuacuc

SEQ ID NO: 6579 - RNA, 19 nt, artificial
  Chemically synthesized
aguauuuagaucugagcuu

SEQ ID NO: 6580 - RNA, 19 nt, artificial
  Chemically synthesized
caaugcuccuugaccacau

SEQ ID NO: 6581 - RNA, 19 nt, artificial
  Chemically synthesized
uggcaggaagcaacaucua

SEQ ID NO: 6582 - RNA, 19 nt, artificial
  Chemically synthesized
auccagagccgcuggugua

SEQ ID NO: 6583 - RNA, 19 nt, artificial
  Chemically synthesized
acagaagcagugaggauga

SEQ ID NO: 6584 - RNA, 19 nt, artificial
  Chemically synthesized
cuugggcuuagaacaacua

SEQ ID NO: 6585 - RNA, 19 nt, artificial
  Chemically synthesized
uacuaaauaugagccacaa

SEQ ID NO: 6586 - RNA, 19 nt, artificial
  Chemically synthesized
accaugaguucaaacuucu

SEQ ID NO: 6587 - RNA, 19 nt, artificial
  Chemically synthesized
acuugugaacaccagaguu

SEQ ID NO: 6588 - RNA, 19 nt, artificial
  Chemically synthesized
caaaucucucaaaaggcuu

SEQ ID NO: 6589 - RNA, 19 nt, artificial
  Chemically synthesized
ugaaaugaguugcagcaga

SEQ ID NO: 6590 - RNA, 19 nt, artificial
  Chemically synthesized
ccugagucuuuugaaugga

SEQ ID NO: 6591 - RNA, 19 nt, artificial
  Chemically synthesized
acgucuugccuauaagcua

SEQ ID NO: 6592 - RNA, 19 nt, artificial
  Chemically synthesized
ggcagggaguauacauugc

SEQ ID NO: 6593 - RNA, 19 nt, artificial
  Chemically synthesized
gaaacuugaccuuccugga

SEQ ID NO: 6594 - RNA, 19 nt, artificial
  Chemically synthesized
augaggacuggguaaggaa

SEQ ID NO: 6595 - RNA, 19 nt, artificial
  Chemically synthesized
ccagugcagagggaauaaa

SEQ ID NO: 6596 - RNA, 19 nt, artificial
  Chemically synthesized
auuccauggugcacuagau

SEQ ID NO: 6597 - RNA, 19 nt, artificial
  Chemically synthesized
cucaaucacauaaugacuu

SEQ ID NO: 6598 - RNA, 19 nt, artificial
  Chemically synthesized
cccuaucagggcugugugu

SEQ ID NO: 6599 - RNA, 19 nt, artificial
  Chemically synthesized
agaaguugaucuaccaagc

SEQ ID NO: 6600 - RNA, 19 nt, artificial
  Chemically synthesized
accacuauuuuucaaggaa

SEQ ID NO: 6601 - RNA, 19 nt, artificial
  Chemically synthesized
gugcacauaucccuaugua

SEQ ID NO: 6602 - RNA, 19 nt, artificial
  Chemically synthesized
cgccuucucagcaggaaca

SEQ ID NO: 6603 - RNA, 19 nt, artificial
  Chemically synthesized
guccugcagaagguggaga

SEQ ID NO: 6604 - RNA, 19 nt, artificial
  Chemically synthesized
caaagugauuuugggacaa

SEQ ID NO: 6605 - RNA, 19 nt, artificial
  Chemically synthesized
uccuaaggaaaccugauua

SEQ ID NO: 6606 - RNA, 19 nt, artificial
  Chemically synthesized
gguaaaucauggaauccag

SEQ ID NO: 6607 - RNA, 19 nt, artificial
  Chemically synthesized
uaguaucuguuguagcagu

SEQ ID NO: 6608 - RNA, 19 nt, artificial
  Chemically synthesized
guguuuccaugucucaugu

SEQ ID NO: 6609 - RNA, 19 nt, artificial
  Chemically synthesized
aaacaaugugucuggaauu

SEQ ID NO: 6610 - RNA, 19 nt, artificial
  Chemically synthesized
aucuucacagagcugagaa

SEQ ID NO: 6611 - RNA, 19 nt, artificial
  Chemically synthesized
ugacuauugaaaggguaaa

SEQ ID NO: 6612 - RNA, 19 nt, artificial
  Chemically synthesized
aaucuagcaucucuagaga

SEQ ID NO: 6613 - RNA, 19 nt, artificial
  Chemically synthesized
gaaaaggaggaagggagaa

SEQ ID NO: 6614 - RNA, 19 nt, artificial
  Chemically synthesized
acaaaaguccagaaugcua

SEQ ID NO: 6615 - RNA, 19 nt, artificial
  Chemically synthesized
agacagagaaaacagaaag

SEQ ID NO: 6616 - RNA, 19 nt, artificial
  Chemically synthesized
gaacaucccuggguguguu

SEQ ID NO: 6617 - RNA, 19 nt, artificial
  Chemically synthesized
cucacaaccauccugguca

SEQ ID NO: 6618 - RNA, 19 nt, artificial
  Chemically synthesized
cuuuagcccagaacugcuu

SEQ ID NO: 6619 - RNA, 19 nt, artificial
  Chemically synthesized
ggaaugcuuuuucagaagu

SEQ ID NO: 6620 - RNA, 19 nt, artificial
  Chemically synthesized
gauggaccucugaaucucu

SEQ ID NO: 6621 - RNA, 19 nt, artificial
  Chemically synthesized
agccuugaguuucuagauc

SEQ ID NO: 6622 - RNA, 19 nt, artificial
  Chemically synthesized
gaacuacagcauuuuccaa

SEQ ID NO: 6623 - RNA, 19 nt, artificial
  Chemically synthesized
uuucggauggcaacauuua

SEQ ID NO: 6624 - RNA, 19 nt, artificial
  Chemically synthesized
caguggguacaggaugcaa

SEQ ID NO: 6625 - RNA, 19 nt, artificial
  Chemically synthesized
ccuccagguucuugauuac

SEQ ID NO: 6626 - RNA, 19 nt, artificial
  Chemically synthesized
acaaugugucuggaauuaa

SEQ ID NO: 6627 - RNA, 19 nt, artificial
  Chemically synthesized
gguggagcuguaccgccuu

SEQ ID NO: 6628 - RNA, 19 nt, artificial
  Chemically synthesized
gagaauuuagaaaugaagg

SEQ ID NO: 6629 - RNA, 19 nt, artificial
  Chemically synthesized
gguucuacaucaaaugccc

SEQ ID NO: 6630 - RNA, 19 nt, artificial
  Chemically synthesized
gggaaugcuuuuucagaag

SEQ ID NO: 6631 - RNA, 19 nt, artificial
  Chemically synthesized
cagccuaaaguauuuagau

SEQ ID NO: 6632 - RNA, 19 nt, artificial
  Chemically synthesized
ggcaugccugugcugaguu

SEQ ID NO: 6633 - RNA, 19 nt, artificial
  Chemically synthesized
gugugcauuugugcacaua

SEQ ID NO: 6634 - RNA, 19 nt, artificial
  Chemically synthesized
gaaaggugauuguuguggu

SEQ ID NO: 6635 - RNA, 19 nt, artificial
  Chemically synthesized
uuauaauuucggauggcaa

SEQ ID NO: 6636 - RNA, 19 nt, artificial
  Chemically synthesized
gcucggucagacggugaua

SEQ ID NO: 6637 - RNA, 19 nt, artificial
  Chemically synthesized
agaaauuaggcuucauaag

SEQ ID NO: 6638 - RNA, 19 nt, artificial
  Chemically synthesized
ucuacuugaugacugcagu

SEQ ID NO: 6639 - RNA, 19 nt, artificial
  Chemically synthesized
ucuacucaagccaggauga

SEQ ID NO: 6640 - RNA, 19 nt, artificial
  Chemically synthesized
cucagaaugacuuugcuug

SEQ ID NO: 6641 - RNA, 19 nt, artificial
  Chemically synthesized
cuuccaaaaaacaggaacu

SEQ ID NO: 6642 - RNA, 19 nt, artificial
  Chemically synthesized
ccaacucagucaaggaacc

SEQ ID NO: 6643 - RNA, 19 nt, artificial
  Chemically synthesized
uguuugagaugaguucucu

SEQ ID NO: 6644 - RNA, 19 nt, artificial
  Chemically synthesized
gccacaugucaggccuuau

SEQ ID NO: 6645 - RNA, 19 nt, artificial
  Chemically synthesized
cugcauaaaguaugguaga

SEQ ID NO: 6646 - RNA, 19 nt, artificial
  Chemically synthesized
accucauuuaccuugacau

SEQ ID NO: 6647 - RNA, 19 nt, artificial
  Chemically synthesized
uacucaaucucucuuuaga

SEQ ID NO: 6648 - RNA, 19 nt, artificial
  Chemically synthesized
ggucagacggugauagcga

SEQ ID NO: 6649 - RNA, 19 nt, artificial
  Chemically synthesized
agucuagcuuucuuaaauc

SEQ ID NO: 6650 - RNA, 19 nt, artificial
  Chemically synthesized
acacuuaccuggaguggga

SEQ ID NO: 6651 - RNA, 19 nt, artificial
  Chemically synthesized
agaacugcuuugaauacac

SEQ ID NO: 6652 - RNA, 19 nt, artificial
  Chemically synthesized
aguauuaaaugcugccaca

SEQ ID NO: 6653 - RNA, 19 nt, artificial
  Chemically synthesized
ccaggaugaggacugggua

SEQ ID NO: 6654 - RNA, 19 nt, artificial
  Chemically synthesized
ggucugcaggcguuuucuu

SEQ ID NO: 6655 - RNA, 19 nt, artificial
  Chemically synthesized
ccucgaugauauuauugac

SEQ ID NO: 6656 - RNA, 19 nt, artificial
  Chemically synthesized
agcaacaagauucaaagua

SEQ ID NO: 6657 - RNA, 19 nt, artificial
  Chemically synthesized
uggcugguuuagaagucca

SEQ ID NO: 6658 - RNA, 19 nt, artificial
  Chemically synthesized
cagauaucuucacagagcu

SEQ ID NO: 6659 - RNA, 19 nt, artificial
  Chemically synthesized
gacuuugcuuguacuugug

SEQ ID NO: 6660 - RNA, 19 nt, artificial
  Chemically synthesized
aucaccugucagaugaaua

SEQ ID NO: 6661 - RNA, 19 nt, artificial
  Chemically synthesized
ggcuuguccagucucgaag

SEQ ID NO: 6662 - RNA, 19 nt, artificial
  Chemically synthesized
ggaggucaccuuuucuuga

SEQ ID NO: 6663 - RNA, 19 nt, artificial
  Chemically synthesized
ugaccacagucagaagugu

SEQ ID NO: 6664 - RNA, 19 nt, artificial
  Chemically synthesized
uccugcgugagaccagaaa

SEQ ID NO: 6665 - RNA, 19 nt, artificial
  Chemically synthesized
ugccuuuguuaucuacuca

SEQ ID NO: 6666 - RNA, 19 nt, artificial
  Chemically synthesized
uguuugauggaccucugaa

SEQ ID NO: 6667 - RNA, 19 nt, artificial
  Chemically synthesized
gcggcacaucuucuggaga

SEQ ID NO: 6668 - RNA, 19 nt, artificial
  Chemically synthesized
cacagagcugagaaacuug

SEQ ID NO: 6669 - RNA, 19 nt, artificial
  Chemically synthesized
ggagaacuacgugugaagg

SEQ ID NO: 6670 - RNA, 19 nt, artificial
  Chemically synthesized
cguuuucuucuucuaacuu

SEQ ID NO: 6671 - RNA, 19 nt, artificial
  Chemically synthesized
gggugauugaacaucccug

SEQ ID NO: 6672 - RNA, 19 nt, artificial
  Chemically synthesized
uguucauccagccuccuca

SEQ ID NO: 6673 - RNA, 19 nt, artificial
  Chemically synthesized
agccgaaaggugauuguug

SEQ ID NO: 6674 - RNA, 19 nt, artificial
  Chemically synthesized
caccagugccucagaaacu

SEQ ID NO: 6675 - RNA, 19 nt, artificial
  Chemically synthesized
aaacuuguauucaaggucu

SEQ ID NO: 6676 - RNA, 19 nt, artificial
  Chemically synthesized
uguacuugugaacaccaga

SEQ ID NO: 6677 - RNA, 19 nt, artificial
  Chemically synthesized
ugccugugcugaguuugaa

SEQ ID NO: 6678 - RNA, 19 nt, artificial
  Chemically synthesized
gagacaaaucuagcaucuc

SEQ ID NO: 6679 - RNA, 19 nt, artificial
  Chemically synthesized
agggaguauacauugcugu

SEQ ID NO: 6680 - RNA, 19 nt, artificial
  Chemically synthesized
ccuggaccucucucagugu

SEQ ID NO: 6681 - RNA, 19 nt, artificial
  Chemically synthesized
gccuuccucuccugcguga

SEQ ID NO: 6682 - RNA, 19 nt, artificial
  Chemically synthesized
ggaugcaauuggcaggaag

SEQ ID NO: 6683 - RNA, 19 nt, artificial
  Chemically synthesized
aguucaaacuucuugggcu

SEQ ID NO: 6684 - RNA, 19 nt, artificial
  Chemically synthesized
uccgauuagcauacuuaga

SEQ ID NO: 6685 - RNA, 19 nt, artificial
  Chemically synthesized
uucagaguguguuugguuu

SEQ ID NO: 6686 - RNA, 19 nt, artificial
  Chemically synthesized
aagggugaguaauuccaug

SEQ ID NO: 6687 - RNA, 19 nt, artificial
  Chemically synthesized
ccuggucauucucgagcau

SEQ ID NO: 6688 - RNA, 19 nt, artificial
  Chemically synthesized
aguucuggucuauaaguuc

SEQ ID NO: 6689 - RNA, 19 nt, artificial
  Chemically synthesized
acuguaaauuuggacaguu

SEQ ID NO: 6690 - RNA, 19 nt, artificial
  Chemically synthesized
agucuaguggcuaauuccu

SEQ ID NO: 6691 - RNA, 19 nt, artificial
  Chemically synthesized
caaagaaagucauuucaac

SEQ ID NO: 6692 - RNA, 19 nt, artificial
  Chemically synthesized
aauguggcucacaaucuua

SEQ ID NO: 6693 - RNA, 19 nt, artificial
  Chemically synthesized
uaagggugaguaauuccau

SEQ ID NO: 6694 - RNA, 19 nt, artificial
  Chemically synthesized
cauggaauccagaaggaac

SEQ ID NO: 6695 - RNA, 19 nt, artificial
  Chemically synthesized
cccuuaucccuuaugcuug

SEQ ID NO: 6696 - RNA, 19 nt, artificial
  Chemically synthesized
aggugggaaugcuuuuuca

SEQ ID NO: 6697 - RNA, 19 nt, artificial
  Chemically synthesized
gcauuccaauuugaaacaa

SEQ ID NO: 6698 - RNA, 19 nt, artificial
  Chemically synthesized
cuagagcacuuggaccuuu

SEQ ID NO: 6699 - RNA, 19 nt, artificial
  Chemically synthesized
aacaaugugucuggaauua

SEQ ID NO: 6700 - RNA, 19 nt, artificial
  Chemically synthesized
aucucaaggagcuuccagu

SEQ ID NO: 6701 - RNA, 19 nt, artificial
  Chemically synthesized
uugauuacagucucaauca

SEQ ID NO: 6702 - RNA, 19 nt, artificial
  Chemically synthesized
ggaacacuuaccuggagug

SEQ ID NO: 6703 - RNA, 19 nt, artificial
  Chemically synthesized
uuugguuugagcaggucua

SEQ ID NO: 6704 - RNA, 19 nt, artificial
  Chemically synthesized
gacugucaugaaagcagca

SEQ ID NO: 6705 - RNA, 19 nt, artificial
  Chemically synthesized
aaacaucuaugaugccuuu

SEQ ID NO: 6706 - RNA, 19 nt, artificial
  Chemically synthesized
gaugucauuccaaaguuau

SEQ ID NO: 6707 - RNA, 19 nt, artificial
  Chemically synthesized
gcugguaucaucuucauug

SEQ ID NO: 6708 - RNA, 19 nt, artificial
  Chemically synthesized
uccagugcagagggaauaa

SEQ ID NO: 6709 - RNA, 19 nt, artificial
  Chemically synthesized
guguuuguuacugaguguu

SEQ ID NO: 6710 - RNA, 19 nt, artificial
  Chemically synthesized
augaaagcagcauugaaau

SEQ ID NO: 6711 - RNA, 19 nt, artificial
  Chemically synthesized
uccgcaugaucauaucugu

SEQ ID NO: 6712 - RNA, 19 nt, artificial
  Chemically synthesized
gagugugacuauugaaagg

SEQ ID NO: 6713 - RNA, 19 nt, artificial
  Chemically synthesized
cuucucacugccaggagaa

SEQ ID NO: 6714 - RNA, 19 nt, artificial
  Chemically synthesized
gaguuuccugcaauggauc

SEQ ID NO: 6715 - RNA, 19 nt, artificial
  Chemically synthesized
gucacucgaugucauucca

SEQ ID NO: 6716 - RNA, 19 nt, artificial
  Chemically synthesized
guguguuuccaugucucau

SEQ ID NO: 6717 - RNA, 19 nt, artificial
  Chemically synthesized
aagaguggauguuaucauu

SEQ ID NO: 6718 - RNA, 19 nt, artificial
  Chemically synthesized
uaauguggcucacaaucuu

SEQ ID NO: 6719 - RNA, 19 nt, artificial
  Chemically synthesized
ggaauccagaaggaacagu

SEQ ID NO: 6720 - RNA, 19 nt, artificial
  Chemically synthesized
gcuaagggugaguaauucc

SEQ ID NO: 6721 - RNA, 19 nt, artificial
  Chemically synthesized
caaucucucuuuagaccug

SEQ ID NO: 6722 - RNA, 19 nt, artificial
  Chemically synthesized
gaccaaucuagagcacuug

SEQ ID NO: 6723 - RNA, 19 nt, artificial
  Chemically synthesized
gcaggaacacuuaccugga

SEQ ID NO: 6724 - RNA, 19 nt, artificial
  Chemically synthesized
ggucuggcugguuuagaag

SEQ ID NO: 6725 - RNA, 19 nt, artificial
  Chemically synthesized
uuccaugucucauguacua

SEQ ID NO: 6726 - RNA, 19 nt, artificial
  Chemically synthesized
cacaaucuuauccaaucuu

SEQ ID NO: 6727 - RNA, 19 nt, artificial
  Chemically synthesized
gacaucucaaaacuuugaa

SEQ ID NO: 6728 - RNA, 19 nt, artificial
  Chemically synthesized
acuuggaccuuuccagcaa

SEQ ID NO: 6729 - RNA, 19 nt, artificial
  Chemically synthesized
cguuugguucugggagaau

SEQ ID NO: 6730 - RNA, 19 nt, artificial
  Chemically synthesized
aguauuccuaucacucaga

SEQ ID NO: 6731 - RNA, 19 nt, artificial
  Chemically synthesized
aguagaugugugcauuugu

SEQ ID NO: 6732 - RNA, 19 nt, artificial
  Chemically synthesized
guggauguuaucauugaga

SEQ ID NO: 6733 - RNA, 19 nt, artificial
  Chemically synthesized
gguucccagaaaagaaugu

SEQ ID NO: 6734 - RNA, 19 nt, artificial
  Chemically synthesized
ucuguauagaagagagugu

SEQ ID NO: 6735 - RNA, 19 nt, artificial
  Chemically synthesized
auaagaccaucauuggugu

SEQ ID NO: 6736 - RNA, 19 nt, artificial
  Chemically synthesized
ucuugaaaauggcuggcaa

SEQ ID NO: 6737 - RNA, 19 nt, artificial
  Chemically synthesized
aguuuccugcaauggauca

SEQ ID NO: 6738 - RNA, 19 nt, artificial
  Chemically synthesized
acagagcugagaaacuuga

SEQ ID NO: 6739 - RNA, 19 nt, artificial
  Chemically synthesized
cugaguuugaauaucaccu

SEQ ID NO: 6740 - RNA, 19 nt, artificial
  Chemically synthesized
acauucaagaaaaggacaa

SEQ ID NO: 6741 - RNA, 19 nt, artificial
  Chemically synthesized
accuuuucuugauuccaga

SEQ ID NO: 6742 - RNA, 19 nt, artificial
  Chemically synthesized
ccagaacugcuuugaauac

SEQ ID NO: 6743 - RNA, 19 nt, artificial
  Chemically synthesized
agugauuuugggacaacca

SEQ ID NO: 6744 - RNA, 19 nt, artificial
  Chemically synthesized
uucuggacuaucaaguuua

SEQ ID NO: 6745 - RNA, 19 nt, artificial
  Chemically synthesized
gcuagaggcaggaaggaag

SEQ ID NO: 6746 - RNA, 19 nt, artificial
  Chemically synthesized
ugagaaacuugaccuuccu

SEQ ID NO: 6747 - RNA, 19 nt, artificial
  Chemically synthesized
ccaacaucauccaugaagg

SEQ ID NO: 6748 - RNA, 19 nt, artificial
  Chemically synthesized
cagaaguugaucuaccaag

SEQ ID NO: 6749 - RNA, 19 nt, artificial
  Chemically synthesized
uuccaaguagucuagcuuu

SEQ ID NO: 6750 - RNA, 19 nt, artificial
  Chemically synthesized
agccgcugguguaucuuug

SEQ ID NO: 6751 - RNA, 19 nt, artificial
  Chemically synthesized
guuguagcaguucuggucu

SEQ ID NO: 6752 - RNA, 19 nt, artificial
  Chemically synthesized
cuggcaguuucugagcagu

SEQ ID NO: 6753 - RNA, 19 nt, artificial
  Chemically synthesized
agaggcagcucuuggugga

SEQ ID NO: 6754 - RNA, 19 nt, artificial
  Chemically synthesized
guguguauuugaaagugug

SEQ ID NO: 6755 - RNA, 19 nt, artificial
  Chemically synthesized
ccagcaacaagauucaaag

SEQ ID NO: 6756 - RNA, 19 nt, artificial
  Chemically synthesized
guuuguuacugaguguuuc

SEQ ID NO: 6757 - RNA, 19 nt, artificial
  Chemically synthesized
cuaucugaagaggaaaaau

SEQ ID NO: 6758 - RNA, 19 nt, artificial
  Chemically synthesized
auguacuagugaaaguaga

SEQ ID NO: 6759 - RNA, 19 nt, artificial
  Chemically synthesized
aucuaccaagccuugaguu

SEQ ID NO: 6760 - RNA, 19 nt, artificial
  Chemically synthesized
cgguccucagugugcuugu

SEQ ID NO: 6761 - RNA, 19 nt, artificial
  Chemically synthesized
guccagaaugcuaagguug

SEQ ID NO: 6762 - RNA, 19 nt, artificial
  Chemically synthesized
gcuguguguauuugaaagu

SEQ ID NO: 6763 - RNA, 19 nt, artificial
  Chemically synthesized
guuuccugcaauggaucaa

SEQ ID NO: 6764 - RNA, 19 nt, artificial
  Chemically synthesized
guuuucaguauuccuauca

SEQ ID NO: 6765 - RNA, 19 nt, artificial
  Chemically synthesized
cuguuguagcaguucuggu

SEQ ID NO: 6766 - RNA, 19 nt, artificial
  Chemically synthesized
gagccuaagccaccucucu

SEQ ID NO: 6767 - RNA, 19 nt, artificial
  Chemically synthesized
ccuucagauaagcagggca

SEQ ID NO: 6768 - RNA, 19 nt, artificial
  Chemically synthesized
aaauccagacaauugaaga

SEQ ID NO: 6769 - RNA, 19 nt, artificial
  Chemically synthesized
agucucaaucacauaauga

SEQ ID NO: 6770 - RNA, 19 nt, artificial
  Chemically synthesized
guucuuauaaagaagguuc

SEQ ID NO: 6771 - RNA, 19 nt, artificial
  Chemically synthesized
agcugguggcuguggagac

SEQ ID NO: 6772 - RNA, 19 nt, artificial
  Chemically synthesized
ccucucacccuuuagccca

SEQ ID NO: 6773 - RNA, 19 nt, artificial
  Chemically synthesized
aggugauuguugugguguc

SEQ ID NO: 6774 - RNA, 19 nt, artificial
  Chemically synthesized
gaaggaagugggaugaccu

SEQ ID NO: 6775 - RNA, 19 nt, artificial
  Chemically synthesized
accauugaagaauuccgau

SEQ ID NO: 6776 - RNA, 19 nt, artificial
  Chemically synthesized
auggcaucuucaauggcuu

SEQ ID NO: 6777 - RNA, 19 nt, artificial
  Chemically synthesized
gucgguccucagugugcuu

SEQ ID NO: 6778 - RNA, 19 nt, artificial
  Chemically synthesized
acagcauuuuccaaguagu

SEQ ID NO: 6779 - RNA, 19 nt, artificial
  Chemically synthesized
gagcugagaaacuugaccu

SEQ ID NO: 6780 - RNA, 19 nt, artificial
  Chemically synthesized
cagggcuguguguauuuga

SEQ ID NO: 6781 - RNA, 19 nt, artificial
  Chemically synthesized
ccuuccagauaucuucaca

SEQ ID NO: 6782 - RNA, 19 nt, artificial
  Chemically synthesized
uggaccucugaaucucuuu

SEQ ID NO: 6783 - RNA, 19 nt, artificial
  Chemically synthesized
caacagcauuuaacucacu

SEQ ID NO: 6784 - RNA, 19 nt, artificial
  Chemically synthesized
uauccaaccaggugcauuu

SEQ ID NO: 6785 - RNA, 19 nt, artificial
  Chemically synthesized
agucuucagguacuaaaua

SEQ ID NO: 6786 - RNA, 19 nt, artificial
  Chemically synthesized
aguuucuagaucucaguag

SEQ ID NO: 6787 - RNA, 19 nt, artificial
  Chemically synthesized
ugcaauuggcaggaagcaa

SEQ ID NO: 6788 - RNA, 19 nt, artificial
  Chemically synthesized
gggcggcacaucuucugga

SEQ ID NO: 6789 - RNA, 19 nt, artificial
  Chemically synthesized
ccagccuaaaguauuuaga

SEQ ID NO: 6790 - RNA, 19 nt, artificial
  Chemically synthesized
guauuauguuauagccauc

SEQ ID NO: 6791 - RNA, 19 nt, artificial
  Chemically synthesized
gauguuugauggaccucug

SEQ ID NO: 6792 - RNA, 19 nt, artificial
  Chemically synthesized
uggacaguuucccacauug

SEQ ID NO: 6793 - RNA, 19 nt, artificial
  Chemically synthesized
augaaggaaacuuggaaaa

SEQ ID NO: 6794 - RNA, 19 nt, artificial
  Chemically synthesized
agcauuccaauuugaaaca

SEQ ID NO: 6795 - RNA, 19 nt, artificial
  Chemically synthesized
aauuucggauggcaacauu

SEQ ID NO: 6796 - RNA, 19 nt, artificial
  Chemically synthesized
uguuauuaccaugaguuca

SEQ ID NO: 6797 - RNA, 19 nt, artificial
  Chemically synthesized
aguguguguguccgcauga

SEQ ID NO: 6798 - RNA, 19 nt, artificial
  Chemically synthesized
caugacaaagaaagucauu

SEQ ID NO: 6799 - RNA, 19 nt, artificial
  Chemically synthesized
guauuuuucuaaucugacc

SEQ ID NO: 6800 - RNA, 19 nt, artificial
  Chemically synthesized
agagaaacaaaaguccaga

SEQ ID NO: 6801 - RNA, 19 nt, artificial
  Chemically synthesized
cuuuauccaaccaggugca

SEQ ID NO: 6802 - RNA, 19 nt, artificial
  Chemically synthesized
guguuugguuugagcaggu

SEQ ID NO: 6803 - RNA, 19 nt, artificial
  Chemically synthesized
uacguuuccuuauaagugu

SEQ ID NO: 6804 - RNA, 19 nt, artificial
  Chemically synthesized
gucuugccuauaagcuaau

SEQ ID NO: 6805 - RNA, 19 nt, artificial
  Chemically synthesized
cuuccucuccugcgugaga

SEQ ID NO: 6806 - RNA, 19 nt, artificial
  Chemically synthesized
agucuuccaggugggcauu

SEQ ID NO: 6807 - RNA, 19 nt, artificial
  Chemically synthesized
aaccaacucagucaaggaa

SEQ ID NO: 6808 - RNA, 19 nt, artificial
  Chemically synthesized
cugagaaacuugaccuucc

SEQ ID NO: 6809 - RNA, 19 nt, artificial
  Chemically synthesized
uuucaguauuccuaucacu

SEQ ID NO: 6810 - RNA, 19 nt, artificial
  Chemically synthesized
ucauuguccugcagaaggu

SEQ ID NO: 6811 - RNA, 19 nt, artificial
  Chemically synthesized
aaugaaggaaacuuggaaa

SEQ ID NO: 6812 - RNA, 19 nt, artificial
  Chemically synthesized
uucuggucuauaaguucua

SEQ ID NO: 6813 - RNA, 19 nt, artificial
  Chemically synthesized
acugaguguuucagagugu

SEQ ID NO: 6814 - RNA, 19 nt, artificial
  Chemically synthesized
gugggaaugcuuuuucaga

SEQ ID NO: 6815 - RNA, 19 nt, artificial
  Chemically synthesized
cucagugucaacuggagca

SEQ ID NO: 6816 - RNA, 19 nt, artificial
  Chemically synthesized
gggcauaucagagccuaag

SEQ ID NO: 6817 - RNA, 19 nt, artificial
  Chemically synthesized
ccaacagcauuuaacucac

SEQ ID NO: 6818 - RNA, 19 nt, artificial
  Chemically synthesized
ucagaaguugaucuaccaa

SEQ ID NO: 6819 - RNA, 19 nt, artificial
  Chemically synthesized
ucuccugugacaaaagaga

SEQ ID NO: 6820 - RNA, 19 nt, artificial
  Chemically synthesized
guuuucuucuucuaacuuc

SEQ ID NO: 6821 - RNA, 19 nt, artificial
  Chemically synthesized
cuguuugagaugaguucuc

SEQ ID NO: 6822 - RNA, 19 nt, artificial
  Chemically synthesized
aucuuacucagaaugacuu

SEQ ID NO: 6823 - RNA, 19 nt, artificial
  Chemically synthesized
acucagucaaggaacccau

SEQ ID NO: 6824 - RNA, 19 nt, artificial
  Chemically synthesized
cagcaacaagauucaaagu

SEQ ID NO: 6825 - RNA, 19 nt, artificial
  Chemically synthesized
caauggaucaaggaccaga

SEQ ID NO: 6826 - RNA, 19 nt, artificial
  Chemically synthesized
cuugguggaaguugaacga

SEQ ID NO: 6827 - RNA, 19 nt, artificial
  Chemically synthesized
cugugacaaaagagauaac

SEQ ID NO: 6828 - RNA, 19 nt, artificial
  Chemically synthesized
acuuggaaaaguuugacaa

SEQ ID NO: 6829 - RNA, 19 nt, artificial
  Chemically synthesized
augcuuuuucagaaguuga

SEQ ID NO: 6830 - RNA, 19 nt, artificial
  Chemically synthesized
ucaguugucaaaacuggaa

SEQ ID NO: 6831 - RNA, 19 nt, artificial
  Chemically synthesized
uguucuuuuccugagucuu

SEQ ID NO: 6832 - RNA, 19 nt, artificial
  Chemically synthesized
cauuuugggaagaguggau

SEQ ID NO: 6833 - RNA, 19 nt, artificial
  Chemically synthesized
ucuucuucuaacuuccucu

SEQ ID NO: 6834 - RNA, 19 nt, artificial
  Chemically synthesized
agacaacaaaauucaguug

SEQ ID NO: 6835 - RNA, 19 nt, artificial
  Chemically synthesized
auuuccgcuuccuggucuu

SEQ ID NO: 6836 - RNA, 19 nt, artificial
  Chemically synthesized
ucucuacucuugugcuugu

SEQ ID NO: 6837 - RNA, 19 nt, artificial
  Chemically synthesized
cuguauagaagagagugug

SEQ ID NO: 6838 - RNA, 19 nt, artificial
  Chemically synthesized
ugauagcgagccacgcauu

SEQ ID NO: 6839 - RNA, 19 nt, artificial
  Chemically synthesized
gcucuagagggccugugca

SEQ ID NO: 6840 - RNA, 19 nt, artificial
  Chemically synthesized
accagaguuuccugcaaug

SEQ ID NO: 6841 - RNA, 19 nt, artificial
  Chemically synthesized
agaaacagaacauucaaga

SEQ ID NO: 6842 - RNA, 19 nt, artificial
  Chemically synthesized
aacuggguguucacuuuuu

SEQ ID NO: 6843 - RNA, 19 nt, artificial
  Chemically synthesized
ccaucauuggugugucggu

SEQ ID NO: 6844 - RNA, 19 nt, artificial
  Chemically synthesized
auuuggacaguuucccaca

SEQ ID NO: 6845 - RNA, 19 nt, artificial
  Chemically synthesized
aguaugguagaggugaaaa

SEQ ID NO: 6846 - RNA, 19 nt, artificial
  Chemically synthesized
agcgagccacgcauucaca

SEQ ID NO: 6847 - RNA, 19 nt, artificial
  Chemically synthesized
aggaaacuuggaaaaguuu

SEQ ID NO: 6848 - RNA, 19 nt, artificial
  Chemically synthesized
ggaaaccugauuaacacau

SEQ ID NO: 6849 - RNA, 19 nt, artificial
  Chemically synthesized
uugcggguucuacaucaaa

SEQ ID NO: 6850 - RNA, 19 nt, artificial
  Chemically synthesized
ugaacccuaugaacuuuau

SEQ ID NO: 6851 - RNA, 19 nt, artificial
  Chemically synthesized
ugauuguugugguguccca

SEQ ID NO: 6852 - RNA, 19 nt, artificial
  Chemically synthesized
aaaacaaugugucuggaau

SEQ ID NO: 6853 - RNA, 19 nt, artificial
  Chemically synthesized
uaucuguuguagcaguucu

SEQ ID NO: 6854 - RNA, 19 nt, artificial
  Chemically synthesized
ccucaugaaaugaguugca

SEQ ID NO: 6855 - RNA, 19 nt, artificial
  Chemically synthesized
ucuccugcgugagaccaga

SEQ ID NO: 6856 - RNA, 19 nt, artificial
  Chemically synthesized
gugcauuugugcacauauc

SEQ ID NO: 6857 - RNA, 19 nt, artificial
  Chemically synthesized
cccuauguaucccuaucag

SEQ ID NO: 6858 - RNA, 19 nt, artificial
  Chemically synthesized
uagacuacuaccucgauga

SEQ ID NO: 6859 - RNA, 19 nt, artificial
  Chemically synthesized
ggaaaacuuccuuccagau

SEQ ID NO: 6860 - RNA, 19 nt, artificial
  Chemically synthesized
aaauaugaccacagucaga

SEQ ID NO: 6861 - RNA, 19 nt, artificial
  Chemically synthesized
ucccuauguaucccuauca

SEQ ID NO: 6862 - RNA, 19 nt, artificial
  Chemically synthesized
cuaucaaguuuacagaagc

SEQ ID NO: 6863 - RNA, 19 nt, artificial
  Chemically synthesized
gaagaguggauguuaucau

SEQ ID NO: 6864 - RNA, 19 nt, artificial
  Chemically synthesized
gucucaaucacauaaugac

SEQ ID NO: 6865 - RNA, 19 nt, artificial
  Chemically synthesized
ccauggugcacuagauaug

SEQ ID NO: 6866 - RNA, 19 nt, artificial
  Chemically synthesized
agucaaggaacccaugaca

SEQ ID NO: 6867 - RNA, 19 nt, artificial
  Chemically synthesized
gaggcagcucuugguggaa

SEQ ID NO: 6868 - RNA, 19 nt, artificial
  Chemically synthesized
cuugcuggcugcauaaagu

SEQ ID NO: 6869 - RNA, 19 nt, artificial
  Chemically synthesized
gugaaaacaucuaugaugc

SEQ ID NO: 6870 - RNA, 19 nt, artificial
  Chemically synthesized
ggcugcuaaucucaaggag

SEQ ID NO: 6871 - RNA, 19 nt, artificial
  Chemically synthesized
ggcugggacucugauccca

SEQ ID NO: 6872 - RNA, 19 nt, artificial
  Chemically synthesized
gugaguaauuccauggugc

SEQ ID NO: 6873 - RNA, 19 nt, artificial
  Chemically synthesized
guuucagaguguguuuggu

SEQ ID NO: 6874 - RNA, 19 nt, artificial
  Chemically synthesized
aguuuucaguauuccuauc

SEQ ID NO: 6875 - RNA, 19 nt, artificial
  Chemically synthesized
ugcuguuuccuguugggca

SEQ ID NO: 6876 - RNA, 19 nt, artificial
  Chemically synthesized
ggcuuagaacaacuagaac

SEQ ID NO: 6877 - RNA, 19 nt, artificial
  Chemically synthesized
aagguucccagaaaagaau

SEQ ID NO: 6878 - RNA, 19 nt, artificial
  Chemically synthesized
agaaagucauuucaacucu

SEQ ID NO: 6879 - RNA, 19 nt, artificial
  Chemically synthesized
uuaagacgugcuucaaaua

SEQ ID NO: 6880 - RNA, 19 nt, artificial
  Chemically synthesized
cugugcaauuugaccauug

SEQ ID NO: 6881 - RNA, 19 nt, artificial
  Chemically synthesized
aaaggaggaagggagaaau

SEQ ID NO: 6882 - RNA, 19 nt, artificial
  Chemically synthesized
augucaggccuuaugcuaa

SEQ ID NO: 6883 - RNA, 19 nt, artificial
  Chemically synthesized
cccugcguggaggugugaa

SEQ ID NO: 6884 - RNA, 19 nt, artificial
  Chemically synthesized
cuuguacuugugaacacca

SEQ ID NO: 6885 - RNA, 19 nt, artificial
  Chemically synthesized
caggugggcauuucaacca

SEQ ID NO: 6886 - RNA, 19 nt, artificial
  Chemically synthesized
uucagaacaagugauguuu

SEQ ID NO: 6887 - RNA, 19 nt, artificial
  Chemically synthesized
ugcuuuuucagaaguugau

SEQ ID NO: 6888 - RNA, 19 nt, artificial
  Chemically synthesized
gcaggaaggaagugggaug

SEQ ID NO: 6889 - RNA, 19 nt, artificial
  Chemically synthesized
auacauugcuguuuccugu

SEQ ID NO: 6890 - RNA, 19 nt, artificial
  Chemically synthesized
cugaccaaucuagagcacu

SEQ ID NO: 6891 - RNA, 19 nt, artificial
  Chemically synthesized
ugcuuguaguaucuguugu

SEQ ID NO: 6892 - RNA, 19 nt, artificial
  Chemically synthesized
caaaucuagcaucucuaga

SEQ ID NO: 6893 - RNA, 19 nt, artificial
  Chemically synthesized
ucggauggcaacauuuaga

SEQ ID NO: 6894 - RNA, 19 nt, artificial
  Chemically synthesized
cauuuucccuggugagugu

SEQ ID NO: 6895 - RNA, 19 nt, artificial
  Chemically synthesized
caaguuuacagaagcuggu

SEQ ID NO: 6896 - RNA, 19 nt, artificial
  Chemically synthesized
cagagacuuuauucccggu

SEQ ID NO: 6897 - RNA, 19 nt, artificial
  Chemically synthesized
uggguguguuuccaugucu

SEQ ID NO: 6898 - RNA, 19 nt, artificial
  Chemically synthesized
cuccucagaaacagaacau

SEQ ID NO: 6899 - RNA, 19 nt, artificial
  Chemically synthesized
cacaccagaguugcuuuca

SEQ ID NO: 6900 - RNA, 19 nt, artificial
  Chemically synthesized
aucuaugaugccuuuguua

SEQ ID NO: 6901 - RNA, 19 nt, artificial
  Chemically synthesized
cguggaggugugaaaucca

SEQ ID NO: 6902 - RNA, 19 nt, artificial
  Chemically synthesized
uaaauaugagccacaacaa

SEQ ID NO: 6903 - RNA, 19 nt, artificial
  Chemically synthesized
gaacuuuauccaaccaggu

SEQ ID NO: 6904 - RNA, 19 nt, artificial
  Chemically synthesized
aggaaaacuuccuuccaga

SEQ ID NO: 6905 - RNA, 19 nt, artificial
  Chemically synthesized
aguucucuacucuugugcu

SEQ ID NO: 6906 - RNA, 19 nt, artificial
  Chemically synthesized
ccucagaaacagaacauuc

SEQ ID NO: 6907 - RNA, 19 nt, artificial
  Chemically synthesized
uauuccuaucacucagaaa

SEQ ID NO: 6908 - RNA, 19 nt, artificial
  Chemically synthesized
uugcuguucucaaagugau

SEQ ID NO: 6909 - RNA, 19 nt, artificial
  Chemically synthesized
acaaaggugggaaugcuuu

SEQ ID NO: 6910 - RNA, 19 nt, artificial
  Chemically synthesized
gaauguucauccagccucc

SEQ ID NO: 6911 - RNA, 19 nt, artificial
  Chemically synthesized
ccuaucagggcugugugua

SEQ ID NO: 6912 - RNA, 19 nt, artificial
  Chemically synthesized
uuucaaagguugcuguucu

SEQ ID NO: 6913 - RNA, 19 nt, artificial
  Chemically synthesized
ugguguaucuuugaauaug

SEQ ID NO: 6914 - RNA, 19 nt, artificial
  Chemically synthesized
cauccagaguuuagcccug

SEQ ID NO: 6915 - RNA, 19 nt, artificial
  Chemically synthesized
uacagaagcugguggcugu

SEQ ID NO: 6916 - RNA, 19 nt, artificial
  Chemically synthesized
ccugucagaugaauaagac

SEQ ID NO: 6917 - RNA, 19 nt, artificial
  Chemically synthesized
auagggaguugucuaauug

SEQ ID NO: 6918 - RNA, 19 nt, artificial
  Chemically synthesized
uuuaagacgugcuucaaau

SEQ ID NO: 6919 - RNA, 19 nt, artificial
  Chemically synthesized
aucucaguagaaauggcuu

SEQ ID NO: 6920 - RNA, 19 nt, artificial
  Chemically synthesized
agaagcugguggcugugga

SEQ ID NO: 6921 - RNA, 19 nt, artificial
  Chemically synthesized
ucaaggagcuuccagugca

SEQ ID NO: 6922 - RNA, 19 nt, artificial
  Chemically synthesized
cuggugagugugacuauug

SEQ ID NO: 6923 - RNA, 19 nt, artificial
  Chemically synthesized
uauucaaggcagggaguau

SEQ ID NO: 6924 - RNA, 19 nt, artificial
  Chemically synthesized
ucacagagcugagaaacuu

SEQ ID NO: 6925 - RNA, 19 nt, artificial
  Chemically synthesized
uccuggucauucucgagca

SEQ ID NO: 6926 - RNA, 19 nt, artificial
  Chemically synthesized
ggaaacuuggaaaaguuug

SEQ ID NO: 6927 - RNA, 19 nt, artificial
  Chemically synthesized
acaacuagaacaucuggau

SEQ ID NO: 6928 - RNA, 19 nt, artificial
  Chemically synthesized
cuucagauaagcagggcau

SEQ ID NO: 6929 - RNA, 19 nt, artificial
  Chemically synthesized
auaugagccacaacaacuu

SEQ ID NO: 6930 - RNA, 19 nt, artificial
  Chemically synthesized
guguccgcaugaucauauc

SEQ ID NO: 6931 - RNA, 19 nt, artificial
  Chemically synthesized
gaggugugaaauccagaca

SEQ ID NO: 6932 - RNA, 19 nt, artificial
  Chemically synthesized
ucuccagucuucagguacu

SEQ ID NO: 6933 - RNA, 19 nt, artificial
  Chemically synthesized
gguacuaaauaugagccac

SEQ ID NO: 6934 - RNA, 19 nt, artificial
  Chemically synthesized
aguuauugccuacuaagua

SEQ ID NO: 6935 - RNA, 19 nt, artificial
  Chemically synthesized
cuggauuuccagcauucca

SEQ ID NO: 6936 - RNA, 19 nt, artificial
  Chemically synthesized
gaacuggguguucacuuuu

SEQ ID NO: 6937 - RNA, 19 nt, artificial
  Chemically synthesized
gaacaagugauguuugaug

SEQ ID NO: 6938 - RNA, 19 nt, artificial
  Chemically synthesized
cgcuuccuggucuuaucau

SEQ ID NO: 6939 - RNA, 19 nt, artificial
  Chemically synthesized
uucuggagacgacucagaa

SEQ ID NO: 6940 - RNA, 19 nt, artificial
  Chemically synthesized
acaaaugagugaguuuuca

SEQ ID NO: 6941 - RNA, 19 nt, artificial
  Chemically synthesized
agguuguuuaagacgugcu

SEQ ID NO: 6942 - RNA, 19 nt, artificial
  Chemically synthesized
gcagggaguauacauugcu

SEQ ID NO: 6943 - RNA, 19 nt, artificial
  Chemically synthesized
ugcugcucacagaagcagu

SEQ ID NO: 6944 - RNA, 19 nt, artificial
  Chemically synthesized
guauuuagaucugagcuuc

SEQ ID NO: 6945 - RNA, 19 nt, artificial
  Chemically synthesized
gaaacaaaaguccagaaug

SEQ ID NO: 6946 - RNA, 19 nt, artificial
  Chemically synthesized
gaggaugaugccaggauga

SEQ ID NO: 6947 - RNA, 19 nt, artificial
  Chemically synthesized
gucacuuugucacucgaug

SEQ ID NO: 6948 - RNA, 19 nt, artificial
  Chemically synthesized
uuccucuccugugacaaaa

SEQ ID NO: 6949 - RNA, 19 nt, artificial
  Chemically synthesized
auaucuguauagaagagag

SEQ ID NO: 6950 - RNA, 19 nt, artificial
  Chemically synthesized
gaauaugagauugcucaga

SEQ ID NO: 6951 - RNA, 19 nt, artificial
  Chemically synthesized
accucgaugauauuauuga

SEQ ID NO: 6952 - RNA, 19 nt, artificial
  Chemically synthesized
caaaguauuuauugcacag

SEQ ID NO: 6953 - RNA, 19 nt, artificial
  Chemically synthesized
gaaaacuuguauucaaggu

SEQ ID NO: 6954 - RNA, 19 nt, artificial
  Chemically synthesized
gugugaagguauucaaggc

SEQ ID NO: 6955 - RNA, 19 nt, artificial
  Chemically synthesized
agaaaaggacaaucaggau

SEQ ID NO: 6956 - RNA, 19 nt, artificial
  Chemically synthesized
cuugauuacagucucaauc

SEQ ID NO: 6957 - RNA, 19 nt, artificial
  Chemically synthesized
ucagaaugacuuugcuugu

SEQ ID NO: 6958 - RNA, 19 nt, artificial
  Chemically synthesized
ccuggguguguuuccaugu

SEQ ID NO: 6959 - RNA, 19 nt, artificial
  Chemically synthesized
aaugagugaguuuucagua

SEQ ID NO: 6960 - RNA, 19 nt, artificial
  Chemically synthesized
ucuuacucagaaugacuuu

SEQ ID NO: 6961 - RNA, 19 nt, artificial
  Chemically synthesized
aggguaaaagacuuuucuu

SEQ ID NO: 6962 - RNA, 19 nt, artificial
  Chemically synthesized
aauccagacaauugaagau

SEQ ID NO: 6963 - RNA, 19 nt, artificial
  Chemically synthesized
cagaagcagugaggaugau

SEQ ID NO: 6964 - RNA, 19 nt, artificial
  Chemically synthesized
uugaaaggguaaaagacuu

SEQ ID NO: 6965 - RNA, 19 nt, artificial
  Chemically synthesized
guugaucuaccaagccuug

SEQ ID NO: 6966 - RNA, 19 nt, artificial
  Chemically synthesized
gggagacacagauggcugg

SEQ ID NO: 6967 - RNA, 19 nt, artificial
  Chemically synthesized
cuagaucucaguagaaaug

SEQ ID NO: 6968 - RNA, 19 nt, artificial
  Chemically synthesized
ggaugaccucaggagguca

SEQ ID NO: 6969 - RNA, 19 nt, artificial
  Chemically synthesized
ccuuuccagcaacaagauu

SEQ ID NO: 6970 - RNA, 19 nt, artificial
  Chemically synthesized
ucacaaccauccuggucau

SEQ ID NO: 6971 - RNA, 19 nt, artificial
  Chemically synthesized
gcaauuggcaggaagcaac

SEQ ID NO: 6972 - RNA, 19 nt, artificial
  Chemically synthesized
ggcaggaaggaagugggau

SEQ ID NO: 6973 - RNA, 19 nt, artificial
  Chemically synthesized
acgaauggaaugugcaaca

SEQ ID NO: 6974 - RNA, 19 nt, artificial
  Chemically synthesized
cuggcaauucuuuccagga

SEQ ID NO: 6975 - RNA, 19 nt, artificial
  Chemically synthesized
cacuggucugcaggcguuu

SEQ ID NO: 6976 - RNA, 19 nt, artificial
  Chemically synthesized
guggugucccagcacuuca

SEQ ID NO: 6977 - RNA, 19 nt, artificial
  Chemically synthesized
uucucgagcauguucuauu

SEQ ID NO: 6978 - RNA, 19 nt, artificial
  Chemically synthesized
uggaaaaguuugacaaauc

SEQ ID NO: 6979 - RNA, 19 nt, artificial
  Chemically synthesized
aguggcuaauuccuaagga

SEQ ID NO: 6980 - RNA, 19 nt, artificial
  Chemically synthesized
aggucaccuuuucuugauu

SEQ ID NO: 6981 - RNA, 19 nt, artificial
  Chemically synthesized
gauugaacaucccugggug

SEQ ID NO: 6982 - RNA, 19 nt, artificial
  Chemically synthesized
agacuacuaccucgaugau

SEQ ID NO: 6983 - RNA, 19 nt, artificial
  Chemically synthesized
uugguucugggagaauuua

SEQ ID NO: 6984 - RNA, 19 nt, artificial
  Chemically synthesized
cauaucuguauagaagaga

SEQ ID NO: 6985 - RNA, 19 nt, artificial
  Chemically synthesized
uucuuuuccugagucuuuu

SEQ ID NO: 6986 - RNA, 19 nt, artificial
  Chemically synthesized
agacgugcuucaaauaucc

SEQ ID NO: 6987 - RNA, 19 nt, artificial
  Chemically synthesized
ccugcagaagguggagaag

SEQ ID NO: 6988 - RNA, 19 nt, artificial
  Chemically synthesized
ucuggucuauaaguucuau

SEQ ID NO: 6989 - RNA, 19 nt, artificial
  Chemically synthesized
auuucaacucuuaccucau

SEQ ID NO: 6990 - RNA, 19 nt, artificial
  Chemically synthesized
cuuuucauuggauacguuu

SEQ ID NO: 6991 - RNA, 19 nt, artificial
  Chemically synthesized
aguugaacgaauggaaugu

SEQ ID NO: 6992 - RNA, 19 nt, artificial
  Chemically synthesized
cauuucagcucugccuuca

SEQ ID NO: 6993 - RNA, 19 nt, artificial
  Chemically synthesized
cuguuuccuguugggcaau

SEQ ID NO: 6994 - RNA, 19 nt, artificial
  Chemically synthesized
gaauccagaaggaacagug

SEQ ID NO: 6995 - RNA, 19 nt, artificial
  Chemically synthesized
gucaugaaagcagcauuga

SEQ ID NO: 6996 - RNA, 19 nt, artificial
  Chemically synthesized
ccuaugaacuuuauccaac

SEQ ID NO: 6997 - RNA, 19 nt, artificial
  Chemically synthesized
cuacagcauuuuccaagua

SEQ ID NO: 6998 - RNA, 19 nt, artificial
  Chemically synthesized
cuguggagacaaaucuagc

SEQ ID NO: 6999 - RNA, 19 nt, artificial
  Chemically synthesized
agcuuccagugcagaggga

SEQ ID NO: 7000 - RNA, 19 nt, artificial
  Chemically synthesized
aggaacaguggguacagga

SEQ ID NO: 7001 - RNA, 19 nt, artificial
  Chemically synthesized
ucaacucuuaccucaucaa

SEQ ID NO: 7002 - RNA, 19 nt, artificial
  Chemically synthesized
ccacauuuugggaagagug

SEQ ID NO: 7003 - RNA, 19 nt, artificial
  Chemically synthesized
cuuuucuugauuccagaaa

SEQ ID NO: 7004 - RNA, 19 nt, artificial
  Chemically synthesized
guuucaaagguugcuguuc

SEQ ID NO: 7005 - RNA, 19 nt, artificial
  Chemically synthesized
gcucugccuucacuacaga

SEQ ID NO: 7006 - RNA, 19 nt, artificial
  Chemically synthesized
ugcuaaucucaaggagcuu

SEQ ID NO: 7007 - RNA, 19 nt, artificial
  Chemically synthesized
ugguguuauuaccaugagu

SEQ ID NO: 7008 - RNA, 19 nt, artificial
  Chemically synthesized
ucauguacuagugaaagua

SEQ ID NO: 7009 - RNA, 19 nt, artificial
  Chemically synthesized
acaaccagccuaaaguauu

SEQ ID NO: 7010 - RNA, 19 nt, artificial
  Chemically synthesized
uguacuagugaaaguagau

SEQ ID NO: 7011 - RNA, 19 nt, artificial
  Chemically synthesized
ucacaaucuuauccaaucu

SEQ ID NO: 7012 - RNA, 19 nt, artificial
  Chemically synthesized
guguaucuuugaauaugag

SEQ ID NO: 7013 - RNA, 19 nt, artificial
  Chemically synthesized
agcccugcguggaggugug

SEQ ID NO: 7014 - RNA, 19 nt, artificial
  Chemically synthesized
ccacauugaaacucaaauc

SEQ ID NO: 7015 - RNA, 19 nt, artificial
  Chemically synthesized
uuucaaccaacucagucaa

SEQ ID NO: 7016 - RNA, 19 nt, artificial
  Chemically synthesized
aaugcuccuugaccacauu

SEQ ID NO: 7017 - RNA, 19 nt, artificial
  Chemically synthesized
uccagcaacaagauucaaa

SEQ ID NO: 7018 - RNA, 19 nt, artificial
  Chemically synthesized
cggcucgaggaagagaaga

SEQ ID NO: 7019 - RNA, 19 nt, artificial
  Chemically synthesized
ccacagucagaaguguuug

SEQ ID NO: 7020 - RNA, 19 nt, artificial
  Chemically synthesized
aauggaaugugcaacaccu

SEQ ID NO: 7021 - RNA, 19 nt, artificial
  Chemically synthesized
aguacacucugucacuuug

SEQ ID NO: 7022 - RNA, 19 nt, artificial
  Chemically synthesized
acagaacauucaagaaaag

SEQ ID NO: 7023 - RNA, 19 nt, artificial
  Chemically synthesized
gacaacaaaauucaguugu

SEQ ID NO: 7024 - RNA, 19 nt, artificial
  Chemically synthesized
ucauaagcugacuuuaaga

SEQ ID NO: 7025 - RNA, 19 nt, artificial
  Chemically synthesized
aaauagggaguugucuaau

SEQ ID NO: 7026 - RNA, 19 nt, artificial
  Chemically synthesized
agccuaaaguauuuagauc

SEQ ID NO: 7027 - RNA, 19 nt, artificial
  Chemically synthesized
ccauuuugguaguuuugac

SEQ ID NO: 7028 - RNA, 19 nt, artificial
  Chemically synthesized
ucagugugcuuguaguauc

SEQ ID NO: 7029 - RNA, 19 nt, artificial
  Chemically synthesized
acagaaagagacauuguuc

SEQ ID NO: 7030 - RNA, 19 nt, artificial
  Chemically synthesized
cugccuucacuacagagac

SEQ ID NO: 7031 - RNA, 19 nt, artificial
  Chemically synthesized
cugaacuggguguucacuu

SEQ ID NO: 7032 - RNA, 19 nt, artificial
  Chemically synthesized
ugaaaggguaaaagacuuu

SEQ ID NO: 7033 - RNA, 19 nt, artificial
  Chemically synthesized
gggaagaguggauguuauc

SEQ ID NO: 7034 - RNA, 19 nt, artificial
  Chemically synthesized
gguggagaagacccugcuc

SEQ ID NO: 7035 - RNA, 19 nt, artificial
  Chemically synthesized
ggccauugcugccaacauc

SEQ ID NO: 7036 - RNA, 19 nt, artificial
  Chemically synthesized
aaaaggaggaagggagaaa

SEQ ID NO: 7037 - RNA, 19 nt, artificial
  Chemically synthesized
ugauuaacacaugcucaca

SEQ ID NO: 7038 - RNA, 19 nt, artificial
  Chemically synthesized
agccacaacaacuucuuuu

SEQ ID NO: 7039 - RNA, 19 nt, artificial
  Chemically synthesized
uccgcuuccuggucuuauc

SEQ ID NO: 7040 - RNA, 19 nt, artificial
  Chemically synthesized
agguucuugauuacagucu

SEQ ID NO: 7041 - RNA, 19 nt, artificial
  Chemically synthesized
gcacauaucccuauguauc

SEQ ID NO: 7042 - RNA, 19 nt, artificial
  Chemically synthesized
ugacugaacuggguguuca

SEQ ID NO: 7043 - RNA, 19 nt, artificial
  Chemically synthesized
auggcuguuugagaugagu

SEQ ID NO: 7044 - RNA, 19 nt, artificial
  Chemically synthesized
gaaaacaaugugucuggaa

SEQ ID NO: 7045 - RNA, 19 nt, artificial
  Chemically synthesized
auuuagaucugagcuucaa

SEQ ID NO: 7046 - RNA, 19 nt, artificial
  Chemically synthesized
aaacagaaagagacauugu

SEQ ID NO: 7047 - RNA, 19 nt, artificial
  Chemically synthesized
gggacucugaucccagcca

SEQ ID NO: 7048 - RNA, 19 nt, artificial
  Chemically synthesized
cacuuguucaguuaauaag

SEQ ID NO: 7049 - RNA, 19 nt, artificial
  Chemically synthesized
aacacaugcucacaaccau

SEQ ID NO: 7050 - RNA, 19 nt, artificial
  Chemically synthesized
uuugggacaaccagccuaa

SEQ ID NO: 7051 - RNA, 19 nt, artificial
  Chemically synthesized
caaggagcuuccagugcag

SEQ ID NO: 7052 - RNA, 19 nt, artificial
  Chemically synthesized
ugcugaguuugaauaucac

SEQ ID NO: 7053 - RNA, 19 nt, artificial
  Chemically synthesized
acuuucacuuccaacaaag

SEQ ID NO: 7054 - RNA, 19 nt, artificial
  Chemically synthesized
ugauuacagucucaaucac

SEQ ID NO: 7055 - RNA, 19 nt, artificial
  Chemically synthesized
cugcaggcguuuucuucuu

SEQ ID NO: 7056 - RNA, 19 nt, artificial
  Chemically synthesized
ggcuggcaauucuuuccag

SEQ ID NO: 7057 - RNA, 19 nt, artificial
  Chemically synthesized
caaggaaguauggaaaagu

SEQ ID NO: 7058 - RNA, 19 nt, artificial
  Chemically synthesized
caggccuuaugcuaagggu

SEQ ID NO: 7059 - RNA, 19 nt, artificial
  Chemically synthesized
accuuuccagcaacaagau

SEQ ID NO: 7060 - RNA, 19 nt, artificial
  Chemically synthesized
cauaucagagccuaagcca

SEQ ID NO: 7061 - RNA, 19 nt, artificial
  Chemically synthesized
cucgagcauguucuauuuu

SEQ ID NO: 7062 - RNA, 19 nt, artificial
  Chemically synthesized
uaccuugacauuucucaua

SEQ ID NO: 7063 - RNA, 19 nt, artificial
  Chemically synthesized
ugcuccuugaccacauuuu

SEQ ID NO: 7064 - RNA, 19 nt, artificial
  Chemically synthesized
cggcacaucuucuggagac

SEQ ID NO: 7065 - RNA, 19 nt, artificial
  Chemically synthesized
gcuucaaugguguuauuac

SEQ ID NO: 7066 - RNA, 19 nt, artificial
  Chemically synthesized
acuugaccuuccuggaccu

SEQ ID NO: 7067 - RNA, 19 nt, artificial
  Chemically synthesized
agucagaaguguuuguuac

SEQ ID NO: 7068 - RNA, 19 nt, artificial
  Chemically synthesized
agaauuccgauuagcauac

SEQ ID NO: 7069 - RNA, 19 nt, artificial
  Chemically synthesized
acucuccagucuucaggua

SEQ ID NO: 7070 - RNA, 19 nt, artificial
  Chemically synthesized
ugaacucccuccagguucu

SEQ ID NO: 7071 - RNA, 19 nt, artificial
  Chemically synthesized
ugugcuuguaguaucuguu

SEQ ID NO: 7072 - RNA, 19 nt, artificial
  Chemically synthesized
uaccucaucaaguugaaua

SEQ ID NO: 7073 - RNA, 19 nt, artificial
  Chemically synthesized
cuuagacuacuaccucgau

SEQ ID NO: 7074 - RNA, 19 nt, artificial
  Chemically synthesized
aguguguuugguuugagca

SEQ ID NO: 7075 - RNA, 19 nt, artificial
  Chemically synthesized
cagaaaagcccugcuggau

SEQ ID NO: 7076 - RNA, 19 nt, artificial
  Chemically synthesized
ugugcauuugugcacauau

SEQ ID NO: 7077 - RNA, 19 nt, artificial
  Chemically synthesized
agaccaucauugguguguc

SEQ ID NO: 7078 - RNA, 19 nt, artificial
  Chemically synthesized
gagcuguaccgccuucuca

SEQ ID NO: 7079 - RNA, 19 nt, artificial
  Chemically synthesized
ucuuuagaccugucccuga

SEQ ID NO: 7080 - RNA, 19 nt, artificial
  Chemically synthesized
cugguuuagaaguccaucg

SEQ ID NO: 7081 - RNA, 19 nt, artificial
  Chemically synthesized
acaucuggauuuccagcau

SEQ ID NO: 7082 - RNA, 19 nt, artificial
  Chemically synthesized
ccaagccuugaguuucuag

SEQ ID NO: 7083 - RNA, 19 nt, artificial
  Chemically synthesized
gugcuuguacaguagucuc

SEQ ID NO: 7084 - RNA, 19 nt, artificial
  Chemically synthesized
uagauuugucuccacagcc

SEQ ID NO: 7085 - RNA, 19 nt, artificial
  Chemically synthesized
uucauuucuaaauucuccc

SEQ ID NO: 7086 - RNA, 19 nt, artificial
  Chemically synthesized
auaccaauuagacaacucc

SEQ ID NO: 7087 - RNA, 19 nt, artificial
  Chemically synthesized
aaccuuugaaacucaagcc

SEQ ID NO: 7088 - RNA, 19 nt, artificial
  Chemically synthesized
uguucaaucacccuagacc

SEQ ID NO: 7089 - RNA, 19 nt, artificial
  Chemically synthesized
uaccaauuagacaacuccc

SEQ ID NO: 7090 - RNA, 19 nt, artificial
  Chemically synthesized
uagacaacucccuauuucc

SEQ ID NO: 7091 - RNA, 19 nt, artificial
  Chemically synthesized
ucuacugagaucuagaaac

SEQ ID NO: 7092 - RNA, 19 nt, artificial
  Chemically synthesized
uuucucaaugauaacaucc

SEQ ID NO: 7093 - RNA, 19 nt, artificial
  Chemically synthesized
uucaauagucacacucacc

SEQ ID NO: 7094 - RNA, 19 nt, artificial
  Chemically synthesized
uuggauaagauugugagcc

SEQ ID NO: 7095 - RNA, 19 nt, artificial
  Chemically synthesized
aaauuguccaugauaagac

SEQ ID NO: 7096 - RNA, 19 nt, artificial
  Chemically synthesized
uauaaucacacucucuucu

SEQ ID NO: 7097 - RNA, 19 nt, artificial
  Chemically synthesized
uauaccaauuagacaacuc

SEQ ID NO: 7098 - RNA, 19 nt, artificial
  Chemically synthesized
uuuccuggaaagaauugcc

SEQ ID NO: 7099 - RNA, 19 nt, artificial
  Chemically synthesized
uauucaaagcaguucuggg

SEQ ID NO: 7100 - RNA, 19 nt, artificial
  Chemically synthesized
uauacagauaugaucaugc

SEQ ID NO: 7101 - RNA, 19 nt, artificial
  Chemically synthesized
uagagaacucaucucaaac

SEQ ID NO: 7102 - RNA, 19 nt, artificial
  Chemically synthesized
uguagaacccgcaagucug

SEQ ID NO: 7103 - RNA, 19 nt, artificial
  Chemically synthesized
uucuuuacuagcucauucc

SEQ ID NO: 7104 - RNA, 19 nt, artificial
  Chemically synthesized
aucucaaacagccauagac

SEQ ID NO: 7105 - RNA, 19 nt, artificial
  Chemically synthesized
auugucuggauuucacacc

SEQ ID NO: 7106 - RNA, 19 nt, artificial
  Chemically synthesized
uauuaagguagagaggugg

SEQ ID NO: 7107 - RNA, 19 nt, artificial
  Chemically synthesized
agaucuagaaacucaaggc

SEQ ID NO: 7108 - RNA, 19 nt, artificial
  Chemically synthesized
uuugucuccacagccacca

SEQ ID NO: 7109 - RNA, 19 nt, artificial
  Chemically synthesized
uuagacaacucccuauuuc

SEQ ID NO: 7110 - RNA, 19 nt, artificial
  Chemically synthesized
uaaacuucugcugcaacuc

SEQ ID NO: 7111 - RNA, 19 nt, artificial
  Chemically synthesized
aaagucucuguagugaagg

SEQ ID NO: 7112 - RNA, 19 nt, artificial
  Chemically synthesized
uucuuuucugggaaccuuc

SEQ ID NO: 7113 - RNA, 19 nt, artificial
  Chemically synthesized
uucuaaaccagccagaccu

SEQ ID NO: 7114 - RNA, 19 nt, artificial
  Chemically synthesized
uacuguacaagcacaagag

SEQ ID NO: 7115 - RNA, 19 nt, artificial
  Chemically synthesized
uuucugaggaggcuggaug

SEQ ID NO: 7116 - RNA, 19 nt, artificial
  Chemically synthesized
uacucagguaauuugaaag

SEQ ID NO: 7117 - RNA, 19 nt, artificial
  Chemically synthesized
uuccuuaggaauuagccac

SEQ ID NO: 7118 - RNA, 19 nt, artificial
  Chemically synthesized
aacagcaauguauacuccc

SEQ ID NO: 7119 - RNA, 19 nt, artificial
  Chemically synthesized
ucaacuuccaccaagagcu

SEQ ID NO: 7120 - RNA, 19 nt, artificial
  Chemically synthesized
uuucacuaguacaugagac

SEQ ID NO: 7121 - RNA, 19 nt, artificial
  Chemically synthesized
aaaaaauagaacaugcucg

SEQ ID NO: 7122 - RNA, 19 nt, artificial
  Chemically synthesized
uugcccaacaggaaacagc

SEQ ID NO: 7123 - RNA, 19 nt, artificial
  Chemically synthesized
uuggaagugaaaguaagcc

SEQ ID NO: 7124 - RNA, 19 nt, artificial
  Chemically synthesized
auccauugcaggaaacucu

SEQ ID NO: 7125 - RNA, 19 nt, artificial
  Chemically synthesized
uuuccugucaauauuaagg

SEQ ID NO: 7126 - RNA, 19 nt, artificial
  Chemically synthesized
uuuuccuggaaagaauugc

SEQ ID NO: 7127 - RNA, 19 nt, artificial
  Chemically synthesized
uagacuacuuggaaaaugc

SEQ ID NO: 7128 - RNA, 19 nt, artificial
  Chemically synthesized
uuaagguagagagguggcu

SEQ ID NO: 7129 - RNA, 19 nt, artificial
  Chemically synthesized
uuuuggaagucauuaugug

SEQ ID NO: 7130 - RNA, 19 nt, artificial
  Chemically synthesized
uaagaaaagucuuuuaccc

SEQ ID NO: 7131 - RNA, 19 nt, artificial
  Chemically synthesized
uacaagcacacugaggacc

SEQ ID NO: 7132 - RNA, 19 nt, artificial
  Chemically synthesized
aaacuguccaaauuuacag

SEQ ID NO: 7133 - RNA, 19 nt, artificial
  Chemically synthesized
uucucuuccucgagccgcc

SEQ ID NO: 7134 - RNA, 19 nt, artificial
  Chemically synthesized
aaacagcaauguauacucc

SEQ ID NO: 7135 - RNA, 19 nt, artificial
  Chemically synthesized
uuaagaaagcuagacuacu

SEQ ID NO: 7136 - RNA, 19 nt, artificial
  Chemically synthesized
uacugagaucuagaaacuc

SEQ ID NO: 7137 - RNA, 19 nt, artificial
  Chemically synthesized
uugaguagauaacaaaggc

SEQ ID NO: 7138 - RNA, 19 nt, artificial
  Chemically synthesized
ugaguugguugaaaugccc

SEQ ID NO: 7139 - RNA, 19 nt, artificial
  Chemically synthesized
aagugcucuagauugguca

SEQ ID NO: 7140 - RNA, 19 nt, artificial
  Chemically synthesized
caaccuuugaaacucaagc

SEQ ID NO: 7141 - RNA, 19 nt, artificial
  Chemically synthesized
uuuuauggaaaccuucaug

SEQ ID NO: 7142 - RNA, 19 nt, artificial
  Chemically synthesized
uaaagagauucagaggucc

SEQ ID NO: 7143 - RNA, 19 nt, artificial
  Chemically synthesized
aauuguccaugauaagacc

SEQ ID NO: 7144 - RNA, 19 nt, artificial
  Chemically synthesized
auuugucuccacagccacc

SEQ ID NO: 7145 - RNA, 19 nt, artificial
  Chemically synthesized
aaaguaagccuuuugagag

SEQ ID NO: 7146 - RNA, 19 nt, artificial
  Chemically synthesized
uagagaugcuagauuuguc

SEQ ID NO: 7147 - RNA, 19 nt, artificial
  Chemically synthesized
uuuucugagucgucuccag

SEQ ID NO: 7148 - RNA, 19 nt, artificial
  Chemically synthesized
auuaauuccagacacauug

SEQ ID NO: 7149 - RNA, 19 nt, artificial
  Chemically synthesized
aauucucccagaaccaaac

SEQ ID NO: 7150 - RNA, 19 nt, artificial
  Chemically synthesized
auauaaucacacucucuuc

SEQ ID NO: 7151 - RNA, 19 nt, artificial
  Chemically synthesized
ugacuguggucauauuucc

SEQ ID NO: 7152 - RNA, 19 nt, artificial
  Chemically synthesized
aauuacucacccuuagcau

SEQ ID NO: 7153 - RNA, 19 nt, artificial
  Chemically synthesized
aguuagaagaagaaaacgc

SEQ ID NO: 7154 - RNA, 19 nt, artificial
  Chemically synthesized
uucaaugugggaaacuguc

SEQ ID NO: 7155 - RNA, 19 nt, artificial
  Chemically synthesized
ugucucuuucuguuuucuc

SEQ ID NO: 7156 - RNA, 19 nt, artificial
  Chemically synthesized
uggucaaggagcauugccc

SEQ ID NO: 7157 - RNA, 19 nt, artificial
  Chemically synthesized
uuuauagcuucauucagac

SEQ ID NO: 7158 - RNA, 19 nt, artificial
  Chemically synthesized
auguagaacccgcaagucu

SEQ ID NO: 7159 - RNA, 19 nt, artificial
  Chemically synthesized
ucacccuuagcauaaggcc

SEQ ID NO: 7160 - RNA, 19 nt, artificial
  Chemically synthesized
ugaaacucaagccauuucu

SEQ ID NO: 7161 - RNA, 19 nt, artificial
  Chemically synthesized
aacuuauagaccagaacug

SEQ ID NO: 7162 - RNA, 19 nt, artificial
  Chemically synthesized
uuacccuuucaauagucac

SEQ ID NO: 7163 - RNA, 19 nt, artificial
  Chemically synthesized
aaacucaagccauuucuac

SEQ ID NO: 7164 - RNA, 19 nt, artificial
  Chemically synthesized
gaacucaucucaaacagcc

SEQ ID NO: 7165 - RNA, 19 nt, artificial
  Chemically synthesized
auuucuacugagaucuaga

SEQ ID NO: 7166 - RNA, 19 nt, artificial
  Chemically synthesized
uaccuucacacguaguucu

SEQ ID NO: 7167 - RNA, 19 nt, artificial
  Chemically synthesized
uaguuaucucuuuugucac

SEQ ID NO: 7168 - RNA, 19 nt, artificial
  Chemically synthesized
uaaaugagguuucugagug

SEQ ID NO: 7169 - RNA, 19 nt, artificial
  Chemically synthesized
acuaauucuaaauguugcc

SEQ ID NO: 7170 - RNA, 19 nt, artificial
  Chemically synthesized
auugaaagcaacucuggug

SEQ ID NO: 7171 - RNA, 19 nt, artificial
  Chemically synthesized
auuugauguagaacccgca

SEQ ID NO: 7172 - RNA, 19 nt, artificial
  Chemically synthesized
uacaacagauacuacaagc

SEQ ID NO: 7173 - RNA, 19 nt, artificial
  Chemically synthesized
uucucugucuuuauucaac

SEQ ID NO: 7174 - RNA, 19 nt, artificial
  Chemically synthesized
acuuauagaccagaacugc

SEQ ID NO: 7175 - RNA, 19 nt, artificial
  Chemically synthesized
aaggcuugguagaucaacu

SEQ ID NO: 7176 - RNA, 19 nt, artificial
  Chemically synthesized
uauagcuucauucagacau

SEQ ID NO: 7177 - RNA, 19 nt, artificial
  Chemically synthesized
auaggaauacugaaaacuc

SEQ ID NO: 7178 - RNA, 19 nt, artificial
  Chemically synthesized
uguacuuuuccauacuucc

SEQ ID NO: 7179 - RNA, 19 nt, artificial
  Chemically synthesized
ugucuccacagccaccagc

SEQ ID NO: 7180 - RNA, 19 nt, artificial
  Chemically synthesized
uuuggaaugacaucgagug

SEQ ID NO: 7181 - RNA, 19 nt, artificial
  Chemically synthesized
augcccaccuggaagacuc

SEQ ID NO: 7182 - RNA, 19 nt, artificial
  Chemically synthesized
uagagcagauuugucaaac

SEQ ID NO: 7183 - RNA, 19 nt, artificial
  Chemically synthesized
aagaguagagaacucaucu

SEQ ID NO: 7184 - RNA, 19 nt, artificial
  Chemically synthesized
uugaagaugccauugaaag

SEQ ID NO: 7185 - RNA, 19 nt, artificial
  Chemically synthesized
uuccucauuucucccuucc

SEQ ID NO: 7186 - RNA, 19 nt, artificial
  Chemically synthesized
uauggauauuugaagcacg

SEQ ID NO: 7187 - RNA, 19 nt, artificial
  Chemically synthesized
acaacaaucaccuuucggc

SEQ ID NO: 7188 - RNA, 19 nt, artificial
  Chemically synthesized
uaacaaacacuucugacug

SEQ ID NO: 7189 - RNA, 19 nt, artificial
  Chemically synthesized
uuaucucuuuugucacagg

SEQ ID NO: 7190 - RNA, 19 nt, artificial
  Chemically synthesized
auagauguugcuuccugcc

SEQ ID NO: 7191 - RNA, 19 nt, artificial
  Chemically synthesized
uuucaaauacacacagccc

SEQ ID NO: 7192 - RNA, 19 nt, artificial
  Chemically synthesized
auuuucaagacuucgagac

SEQ ID NO: 7193 - RNA, 19 nt, artificial
  Chemically synthesized
uuuucugggaaccuucuuu

SEQ ID NO: 7194 - RNA, 19 nt, artificial
  Chemically synthesized
ugagacuguaaucaagaac

SEQ ID NO: 7195 - RNA, 19 nt, artificial
  Chemically synthesized
ugccucugguccuugaucc

SEQ ID NO: 7196 - RNA, 19 nt, artificial
  Chemically synthesized
auuuccauucaaaagacuc

SEQ ID NO: 7197 - RNA, 19 nt, artificial
  Chemically synthesized
acuguaaucaagaaccugg

SEQ ID NO: 7198 - RNA, 19 nt, artificial
  Chemically synthesized
uacagcuccaccugcugcc

SEQ ID NO: 7199 - RNA, 19 nt, artificial
  Chemically synthesized
auucagagguccaucaaac

SEQ ID NO: 7200 - RNA, 19 nt, artificial
  Chemically synthesized
auucuaaauguugccaucc

SEQ ID NO: 7201 - RNA, 19 nt, artificial
  Chemically synthesized
auggacuucuaaaccagcc

SEQ ID NO: 7202 - RNA, 19 nt, artificial
  Chemically synthesized
aauuagacaacucccuauu

SEQ ID NO: 7203 - RNA, 19 nt, artificial
  Chemically synthesized
aaaccuucauggaugaugu

SEQ ID NO: 7204 - RNA, 19 nt, artificial
  Chemically synthesized
aaccuuagcauucuggacu

SEQ ID NO: 7205 - RNA, 19 nt, artificial
  Chemically synthesized
uuauucaacuugaugaggu

SEQ ID NO: 7206 - RNA, 19 nt, artificial
  Chemically synthesized
aaugauggucuuauucauc

SEQ ID NO: 7207 - RNA, 19 nt, artificial
  Chemically synthesized
uaaagucucuguagugaag

SEQ ID NO: 7208 - RNA, 19 nt, artificial
  Chemically synthesized
ugacaggugauauucaaac

SEQ ID NO: 7209 - RNA, 19 nt, artificial
  Chemically synthesized
uguuggagacaacugcucc

SEQ ID NO: 7210 - RNA, 19 nt, artificial
  Chemically synthesized
uaugcuaaucggaauucuu

SEQ ID NO: 7211 - RNA, 19 nt, artificial
  Chemically synthesized
uucuucaauggucaaauug

SEQ ID NO: 7212 - RNA, 19 nt, artificial
  Chemically synthesized
uagacauccauuucaaaug

SEQ ID NO: 7213 - RNA, 19 nt, artificial
  Chemically synthesized
uuaaucagguuuccuuagg

SEQ ID NO: 7214 - RNA, 19 nt, artificial
  Chemically synthesized
auucaaacucagcacaggc

SEQ ID NO: 7215 - RNA, 19 nt, artificial
  Chemically synthesized
uuucuuugucauggguucc

SEQ ID NO: 7216 - RNA, 19 nt, artificial
  Chemically synthesized
ucaaaguuuugagaugucc

SEQ ID NO: 7217 - RNA, 19 nt, artificial
  Chemically synthesized
aaccuucuuuauaagaacc

SEQ ID NO: 7218 - RNA, 19 nt, artificial
  Chemically synthesized
ucaaucacccuagaccugc

SEQ ID NO: 7219 - RNA, 19 nt, artificial
  Chemically synthesized
auaccuucacacguaguuc

SEQ ID NO: 7220 - RNA, 19 nt, artificial
  Chemically synthesized
augauauuagcuuauaggc

SEQ ID NO: 7221 - RNA, 19 nt, artificial
  Chemically synthesized
aaucggaauucuucaaugg

SEQ ID NO: 7222 - RNA, 19 nt, artificial
  Chemically synthesized
aagcacgucuuaaacaacc

SEQ ID NO: 7223 - RNA, 19 nt, artificial
  Chemically synthesized
aagucugugcaauaaauac

SEQ ID NO: 7224 - RNA, 19 nt, artificial
  Chemically synthesized
uacuacaagcacacugagg

SEQ ID NO: 7225 - RNA, 19 nt, artificial
  Chemically synthesized
uuuuacccuuucaauaguc

SEQ ID NO: 7226 - RNA, 19 nt, artificial
  Chemically synthesized
ucaaacaucacuuguucug

SEQ ID NO: 7227 - RNA, 19 nt, artificial
  Chemically synthesized
ugcuguuggagacaacugc

SEQ ID NO: 7228 - RNA, 19 nt, artificial
  Chemically synthesized
ugaagguguugcacauucc

SEQ ID NO: 7229 - RNA, 19 nt, artificial
  Chemically synthesized
agucugugcaauaaauacu

SEQ ID NO: 7230 - RNA, 19 nt, artificial
  Chemically synthesized
uuccuuccugccucuagcc

SEQ ID NO: 7231 - RNA, 19 nt, artificial
  Chemically synthesized
uuucaaauuggaaugcugg

SEQ ID NO: 7232 - RNA, 19 nt, artificial
  Chemically synthesized
uucugcaggacaaugaaga

SEQ ID NO: 7233 - RNA, 19 nt, artificial
  Chemically synthesized
auuggaaugcuggaaaucc

SEQ ID NO: 7234 - RNA, 19 nt, artificial
  Chemically synthesized
ucuuguugcuggaaagguc

SEQ ID NO: 7235 - RNA, 19 nt, artificial
  Chemically synthesized
uagagagguggcuuaggcu

SEQ ID NO: 7236 - RNA, 19 nt, artificial
  Chemically synthesized
guuagaagaagaaaacgcc

SEQ ID NO: 7237 - RNA, 19 nt, artificial
  Chemically synthesized
uauucaaacucagcacagg

SEQ ID NO: 7238 - RNA, 19 nt, artificial
  Chemically synthesized
aaguguuggacccagcugg

SEQ ID NO: 7239 - RNA, 19 nt, artificial
  Chemically synthesized
uuccauucaaaagacucag

SEQ ID NO: 7240 - RNA, 19 nt, artificial
  Chemically synthesized
ucugugucucccuaaagag

SEQ ID NO: 7241 - RNA, 19 nt, artificial
  Chemically synthesized
agauacuacaagcacacug

SEQ ID NO: 7242 - RNA, 19 nt, artificial
  Chemically synthesized
uuugucaaacuuuuccaag

SEQ ID NO: 7243 - RNA, 19 nt, artificial
  Chemically synthesized
uuuccucauuucucccuuc

SEQ ID NO: 7244 - RNA, 19 nt, artificial
  Chemically synthesized
uugagaacagcaaccuuug

SEQ ID NO: 7245 - RNA, 19 nt, artificial
  Chemically synthesized
aaugucaagguaaaugagg

SEQ ID NO: 7246 - RNA, 19 nt, artificial
  Chemically synthesized
aauaauaucaucgagguag

SEQ ID NO: 7247 - RNA, 19 nt, artificial
  Chemically synthesized
aaacucacucauuuguuuc

SEQ ID NO: 7248 - RNA, 19 nt, artificial
  Chemically synthesized
uucacaaguacaagcaaag

SEQ ID NO: 7249 - RNA, 19 nt, artificial
  Chemically synthesized
uuaggaauuagccacuaga

SEQ ID NO: 7250 - RNA, 19 nt, artificial
  Chemically synthesized
uaggaauuagccacuagac

SEQ ID NO: 7251 - RNA, 19 nt, artificial
  Chemically synthesized
ucggaauucuucaaugguc

SEQ ID NO: 7252 - RNA, 19 nt, artificial
  Chemically synthesized
uucagggacaggucuaaag

SEQ ID NO: 7253 - RNA, 19 nt, artificial
  Chemically synthesized
aaacacacucugaaacacu

SEQ ID NO: 7254 - RNA, 19 nt, artificial
  Chemically synthesized
aauugucuggauuucacac

SEQ ID NO: 7255 - RNA, 19 nt, artificial
  Chemically synthesized
uucucuagagaugcuagau

SEQ ID NO: 7256 - RNA, 19 nt, artificial
  Chemically synthesized
auauguuucuggaaucaag

SEQ ID NO: 7257 - RNA, 19 nt, artificial
  Chemically synthesized
ucaaugauaacauccacuc

SEQ ID NO: 7258 - RNA, 19 nt, artificial
  Chemically synthesized
uauuuccucauuucucccu

SEQ ID NO: 7259 - RNA, 19 nt, artificial
  Chemically synthesized
agaguagagaacucaucuc

SEQ ID NO: 7260 - RNA, 19 nt, artificial
  Chemically synthesized
uuuugagauguccaauggg

SEQ ID NO: 7261 - RNA, 19 nt, artificial
  Chemically synthesized
uagucuaaguaugcuaauc

SEQ ID NO: 7262 - RNA, 19 nt, artificial
  Chemically synthesized
gagacuguaaucaagaacc

SEQ ID NO: 7263 - RNA, 19 nt, artificial
  Chemically synthesized
uugguugaaaugcccaccu

SEQ ID NO: 7264 - RNA, 19 nt, artificial
  Chemically synthesized
aaaaauaaacuucugcugc

SEQ ID NO: 7265 - RNA, 19 nt, artificial
  Chemically synthesized
uucacacguaguucuccug

SEQ ID NO: 7266 - RNA, 19 nt, artificial
  Chemically synthesized
cuuucaaauacacacagcc

SEQ ID NO: 7267 - RNA, 19 nt, artificial
  Chemically synthesized
aauauuaagguagagaggu

SEQ ID NO: 7268 - RNA, 19 nt, artificial
  Chemically synthesized
uuuaagaaagcuagacuac

SEQ ID NO: 7269 - RNA, 19 nt, artificial
  Chemically synthesized
uucaagacuucgagacugg

SEQ ID NO: 7270 - RNA, 19 nt, artificial
  Chemically synthesized
uuguccaugauaagaccag

SEQ ID NO: 7271 - RNA, 19 nt, artificial
  Chemically synthesized
ugaauguucuguuucugag

SEQ ID NO: 7272 - RNA, 19 nt, artificial
  Chemically synthesized
uuagcauucuggacuuuug

SEQ ID NO: 7273 - RNA, 19 nt, artificial
  Chemically synthesized
uagaagaagaaaacgccug

SEQ ID NO: 7274 - RNA, 19 nt, artificial
  Chemically synthesized
uuagccacuagacuuuaac

SEQ ID NO: 7275 - RNA, 19 nt, artificial
  Chemically synthesized
uuuccuuaggaauuagcca

SEQ ID NO: 7276 - RNA, 19 nt, artificial
  Chemically synthesized
agaacucaucucaaacagc

SEQ ID NO: 7277 - RNA, 19 nt, artificial
  Chemically synthesized
cauuugauguagaacccgc

SEQ ID NO: 7278 - RNA, 19 nt, artificial
  Chemically synthesized
uuugaagcacgucuuaaac

SEQ ID NO: 7279 - RNA, 19 nt, artificial
  Chemically synthesized
ugagacauggaaacacacc

SEQ ID NO: 7280 - RNA, 19 nt, artificial
  Chemically synthesized
uucuguaaacuugauaguc

SEQ ID NO: 7281 - RNA, 19 nt, artificial
  Chemically synthesized
aauggauguauucuucaag

SEQ ID NO: 7282 - RNA, 19 nt, artificial
  Chemically synthesized
aacucaagccauuucuacu

SEQ ID NO: 7283 - RNA, 19 nt, artificial
  Chemically synthesized
uagaacccgcaagucugug

SEQ ID NO: 7284 - RNA, 19 nt, artificial
  Chemically synthesized
ucucuuucuguuuucucug

SEQ ID NO: 7285 - RNA, 19 nt, artificial
  Chemically synthesized
aauugguguauucaaagca

SEQ ID NO: 7286 - RNA, 19 nt, artificial
  Chemically synthesized
cacuggugucuucucuucc

SEQ ID NO: 7287 - RNA, 19 nt, artificial
  Chemically synthesized
uguaguuccuguuuuuugg

SEQ ID NO: 7288 - RNA, 19 nt, artificial
  Chemically synthesized
accaauuagacaacucccu

SEQ ID NO: 7289 - RNA, 19 nt, artificial
  Chemically synthesized
uucuugaauguucuguuuc

SEQ ID NO: 7290 - RNA, 19 nt, artificial
  Chemically synthesized
uuugucacaggagaggaag

SEQ ID NO: 7291 - RNA, 19 nt, artificial
  Chemically synthesized
ugauguagaacccgcaagu

SEQ ID NO: 7292 - RNA, 19 nt, artificial
  Chemically synthesized
acuagcucauuccuuaccc

SEQ ID NO: 7293 - RNA, 19 nt, artificial
  Chemically synthesized
uuucaugacagucauuacu

SEQ ID NO: 7294 - RNA, 19 nt, artificial
  Chemically synthesized
uucaaauacacacagcccu

SEQ ID NO: 7295 - RNA, 19 nt, artificial
  Chemically synthesized
aaggaaaaagugaacaccc

SEQ ID NO: 7296 - RNA, 19 nt, artificial
  Chemically synthesized
uuucaagacuucgagacug

SEQ ID NO: 7297 - RNA, 19 nt, artificial
  Chemically synthesized
ucucccuuccuccuuuucc

SEQ ID NO: 7298 - RNA, 19 nt, artificial
  Chemically synthesized
ugauaguccagaaaaggcu

SEQ ID NO: 7299 - RNA, 19 nt, artificial
  Chemically synthesized
ucacaggagaggaaguuag

SEQ ID NO: 7300 - RNA, 19 nt, artificial
  Chemically synthesized
ucucaaacagccauagaca

SEQ ID NO: 7301 - RNA, 19 nt, artificial
  Chemically synthesized
uucuggacuuuuguuucuc

SEQ ID NO: 7302 - RNA, 19 nt, artificial
  Chemically synthesized
aacacuucugacugugguc

SEQ ID NO: 7303 - RNA, 19 nt, artificial
  Chemically synthesized
ucuuucuguuuucucuguc

SEQ ID NO: 7304 - RNA, 19 nt, artificial
  Chemically synthesized
uucugugagcagcaguggc

SEQ ID NO: 7305 - RNA, 19 nt, artificial
  Chemically synthesized
ucaaauggauguauucuuc

SEQ ID NO: 7306 - RNA, 19 nt, artificial
  Chemically synthesized
ugagcauguguuaaucagg

SEQ ID NO: 7307 - RNA, 19 nt, artificial
  Chemically synthesized
auagucacacucaccaggg

SEQ ID NO: 7308 - RNA, 19 nt, artificial
  Chemically synthesized
uuucuguuuucucugucuu

SEQ ID NO: 7309 - RNA, 19 nt, artificial
  Chemically synthesized
uucucaaugauaacaucca

SEQ ID NO: 7310 - RNA, 19 nt, artificial
  Chemically synthesized
auugcaggaaacucuggug

SEQ ID NO: 7311 - RNA, 19 nt, artificial
  Chemically synthesized
uucuggucucacgcaggag

SEQ ID NO: 7312 - RNA, 19 nt, artificial
  Chemically synthesized
uaucugaagguguugcaca

SEQ ID NO: 7313 - RNA, 19 nt, artificial
  Chemically synthesized
uuuaguaccugaagacugg

SEQ ID NO: 7314 - RNA, 19 nt, artificial
  Chemically synthesized
aaagucagcuuaugaagcc

SEQ ID NO: 7315 - RNA, 19 nt, artificial
  Chemically synthesized
uuccugucaauauuaaggu

SEQ ID NO: 7316 - RNA, 19 nt, artificial
  Chemically synthesized
agucuaaguaugcuaaucg

SEQ ID NO: 7317 - RNA, 19 nt, artificial
  Chemically synthesized
uuaacugaacaaguguugg

SEQ ID NO: 7318 - RNA, 19 nt, artificial
  Chemically synthesized
aaugucucuuucuguuuuc

SEQ ID NO: 7319 - RNA, 19 nt, artificial
  Chemically synthesized
guuuccuuaggaauuagcc

SEQ ID NO: 7320 - RNA, 19 nt, artificial
  Chemically synthesized
accuucuuuauaagaaccc

SEQ ID NO: 7321 - RNA, 19 nt, artificial
  Chemically synthesized
aguucucuagagaugcuag

SEQ ID NO: 7322 - RNA, 19 nt, artificial
  Chemically synthesized
aaagacucaggaaaagaac

SEQ ID NO: 7323 - RNA, 19 nt, artificial
  Chemically synthesized
uguucuaagcccaagaagu

SEQ ID NO: 7324 - RNA, 19 nt, artificial
  Chemically synthesized
uaagguagagagguggcuu

SEQ ID NO: 7325 - RNA, 19 nt, artificial
  Chemically synthesized
aaaggaaaaagugaacacc

SEQ ID NO: 7326 - RNA, 19 nt, artificial
  Chemically synthesized
uccuugacugaguugguug

SEQ ID NO: 7327 - RNA, 19 nt, artificial
  Chemically synthesized
cuucauuucuaaauucucc

SEQ ID NO: 7328 - RNA, 19 nt, artificial
  Chemically synthesized
uuagaagaagaaaacgccu

SEQ ID NO: 7329 - RNA, 19 nt, artificial
  Chemically synthesized
agauuugucaaacuuuucc

SEQ ID NO: 7330 - RNA, 19 nt, artificial
  Chemically synthesized
acugagaucuagaaacuca

SEQ ID NO: 7331 - RNA, 19 nt, artificial
  Chemically synthesized
aaauagaacaugcucgaga

SEQ ID NO: 7332 - RNA, 19 nt, artificial
  Chemically synthesized
aagacuucgagacuggaca

SEQ ID NO: 7333 - RNA, 19 nt, artificial
  Chemically synthesized
aaucacuuugagaacagca

SEQ ID NO: 7334 - RNA, 19 nt, artificial
  Chemically synthesized
aauugcauccuguacccac

SEQ ID NO: 7335 - RNA, 19 nt, artificial
  Chemically synthesized
uucaacuuccaccaagagc

SEQ ID NO: 7336 - RNA, 19 nt, artificial
  Chemically synthesized
caaacagccauagacaucc

SEQ ID NO: 7337 - RNA, 19 nt, artificial
  Chemically synthesized
uuucaaugugggaaacugu

SEQ ID NO: 7338 - RNA, 19 nt, artificial
  Chemically synthesized
ugauuuaccauccagcagg

SEQ ID NO: 7339 - RNA, 19 nt, artificial
  Chemically synthesized
agaacuuauagaccagaac

SEQ ID NO: 7340 - RNA, 19 nt, artificial
  Chemically synthesized
auccuguacccacuguucc

SEQ ID NO: 7341 - RNA, 19 nt, artificial
  Chemically synthesized
aaagauacaccagcggcuc

SEQ ID NO: 7342 - RNA, 19 nt, artificial
  Chemically synthesized
aauacugaaaacucacuca

SEQ ID NO: 7343 - RNA, 19 nt, artificial
  Chemically synthesized
aagaaagcuagacuacuug

SEQ ID NO: 7344 - RNA, 19 nt, artificial
  Chemically synthesized
uugaacucaugguaauaac

SEQ ID NO: 7345 - RNA, 19 nt, artificial
  Chemically synthesized
uuaucagcccauauguuuc

SEQ ID NO: 7346 - RNA, 19 nt, artificial
  Chemically synthesized
agacucuguauuuuagucu

SEQ ID NO: 7347 - RNA, 19 nt, artificial
  Chemically synthesized
uuacuuaguaggcaauaac

SEQ ID NO: 7348 - RNA, 19 nt, artificial
  Chemically synthesized
uuucugaggcacugguguc

SEQ ID NO: 7349 - RNA, 19 nt, artificial
  Chemically synthesized
aagcccaagaaguuugaac

SEQ ID NO: 7350 - RNA, 19 nt, artificial
  Chemically synthesized
auuccaugauuuaccaucc

SEQ ID NO: 7351 - RNA, 19 nt, artificial
  Chemically synthesized
ucaauagucacacucacca

SEQ ID NO: 7352 - RNA, 19 nt, artificial
  Chemically synthesized
ucuucagauagauguugcu

SEQ ID NO: 7353 - RNA, 19 nt, artificial
  Chemically synthesized
acagcaaccuuugaaacuc

SEQ ID NO: 7354 - RNA, 19 nt, artificial
  Chemically synthesized
aacucaugguaauaacacc

SEQ ID NO: 7355 - RNA, 19 nt, artificial
  Chemically synthesized
gucuucuccaccuucugca

SEQ ID NO: 7356 - RNA, 19 nt, artificial
  Chemically synthesized
ucuucuccaccuucugcag

SEQ ID NO: 7357 - RNA, 19 nt, artificial
  Chemically synthesized
ugucucccuaaagagauuc

SEQ ID NO: 7358 - RNA, 19 nt, artificial
  Chemically synthesized
aagucucuguagugaaggc

SEQ ID NO: 7359 - RNA, 19 nt, artificial
  Chemically synthesized
gaaacagcaauguauacuc

SEQ ID NO: 7360 - RNA, 19 nt, artificial
  Chemically synthesized
acugaguugguugaaaugc

SEQ ID NO: 7361 - RNA, 19 nt, artificial
  Chemically synthesized
acaaugaagaugauaccag

SEQ ID NO: 7362 - RNA, 19 nt, artificial
  Chemically synthesized
uucacuaguacaugagaca

SEQ ID NO: 7363 - RNA, 19 nt, artificial
  Chemically synthesized
uuagcagcccugcauaucu

SEQ ID NO: 7364 - RNA, 19 nt, artificial
  Chemically synthesized
caagaguagagaacucauc

SEQ ID NO: 7365 - RNA, 19 nt, artificial
  Chemically synthesized
aaucacacucucuucuaua

SEQ ID NO: 7366 - RNA, 19 nt, artificial
  Chemically synthesized
aaagugaacacccaguuca

SEQ ID NO: 7367 - RNA, 19 nt, artificial
  Chemically synthesized
acucccugccuugaauacc

SEQ ID NO: 7368 - RNA, 19 nt, artificial
  Chemically synthesized
accauggaauuacucaccc

SEQ ID NO: 7369 - RNA, 19 nt, artificial
  Chemically synthesized
uccauugcaggaaacucug

SEQ ID NO: 7370 - RNA, 19 nt, artificial
  Chemically synthesized
auguucuaguuguucuaag

SEQ ID NO: 7371 - RNA, 19 nt, artificial
  Chemically synthesized
uuucuacugagaucuagaa

SEQ ID NO: 7372 - RNA, 19 nt, artificial
  Chemically synthesized
uucuacugagaucuagaaa

SEQ ID NO: 7373 - RNA, 19 nt, artificial
  Chemically synthesized
aagaaguuugaacucaugg

SEQ ID NO: 7374 - RNA, 19 nt, artificial
  Chemically synthesized
caucauagauguuuucacc

SEQ ID NO: 7375 - RNA, 19 nt, artificial
  Chemically synthesized
aaacucugguguucacaag

SEQ ID NO: 7376 - RNA, 19 nt, artificial
  Chemically synthesized
uggaauuacucacccuuag

SEQ ID NO: 7377 - RNA, 19 nt, artificial
  Chemically synthesized
agaaugaccaggaugguug

SEQ ID NO: 7378 - RNA, 19 nt, artificial
  Chemically synthesized
ugcuagauuugucuccaca

SEQ ID NO: 7379 - RNA, 19 nt, artificial
  Chemically synthesized
ucucugucuuuauucaacu

SEQ ID NO: 7380 - RNA, 19 nt, artificial
  Chemically synthesized
uugaaagcaacucuggugu

SEQ ID NO: 7381 - RNA, 19 nt, artificial
  Chemically synthesized
ugccauugaaagcaacucu

SEQ ID NO: 7382 - RNA, 19 nt, artificial
  Chemically synthesized
aaacucagcacaggcaugc

SEQ ID NO: 7383 - RNA, 19 nt, artificial
  Chemically synthesized
uucaacuugaugagguaag

SEQ ID NO: 7384 - RNA, 19 nt, artificial
  Chemically synthesized
acaggugauauucaaacuc

SEQ ID NO: 7385 - RNA, 19 nt, artificial
  Chemically synthesized
uaagaaagcuagacuacuu

SEQ ID NO: 7386 - RNA, 19 nt, artificial
  Chemically synthesized
uugucuggauuucacaccu

SEQ ID NO: 7387 - RNA, 19 nt, artificial
  Chemically synthesized
uagcucauuccuuacccag

SEQ ID NO: 7388 - RNA, 19 nt, artificial
  Chemically synthesized
uguuggaagugaaaguaag

SEQ ID NO: 7389 - RNA, 19 nt, artificial
  Chemically synthesized
gaaacugccaggucugagc

SEQ ID NO: 7390 - RNA, 19 nt, artificial
  Chemically synthesized
agagauuugaguuucaaug

SEQ ID NO: 7391 - RNA, 19 nt, artificial
  Chemically synthesized
acuuccuugaaaaauagug

SEQ ID NO: 7392 - RNA, 19 nt, artificial
  Chemically synthesized
acuuccaccaagagcugcc

SEQ ID NO: 7393 - RNA, 19 nt, artificial
  Chemically synthesized
aguucugggcuaaagggug

SEQ ID NO: 7394 - RNA, 19 nt, artificial
  Chemically synthesized
aaugcugcuuucaugacag

SEQ ID NO: 7395 - RNA, 19 nt, artificial
  Chemically synthesized
uagaccagaacugcuacaa

SEQ ID NO: 7396 - RNA, 19 nt, artificial
  Chemically synthesized
aaacacuucugacuguggu

SEQ ID NO: 7397 - RNA, 19 nt, artificial
  Chemically synthesized
uggagagugaguuaaaugc

SEQ ID NO: 7398 - RNA, 19 nt, artificial
  Chemically synthesized
aguucagacacuuauaagg

SEQ ID NO: 7399 - RNA, 19 nt, artificial
  Chemically synthesized
acucaagccauuucuacug

SEQ ID NO: 7400 - RNA, 19 nt, artificial
  Chemically synthesized
uggaagugaaaguaagccu

SEQ ID NO: 7401 - RNA, 19 nt, artificial
  Chemically synthesized
aggacaaugaagaugauac

SEQ ID NO: 7402 - RNA, 19 nt, artificial
  Chemically synthesized
auggucuuauucaucugac

SEQ ID NO: 7403 - RNA, 19 nt, artificial
  Chemically synthesized
aacugaacaaguguuggac

SEQ ID NO: 7404 - RNA, 19 nt, artificial
  Chemically synthesized
ugacaacugaauuuuguug

SEQ ID NO: 7405 - RNA, 19 nt, artificial
  Chemically synthesized
uucaaagcaguucugggcu

SEQ ID NO: 7406 - RNA, 19 nt, artificial
  Chemically synthesized
aaagcaacucuggugugag

SEQ ID NO: 7407 - RNA, 19 nt, artificial
  Chemically synthesized
uugucuccacagccaccag

SEQ ID NO: 7408 - RNA, 19 nt, artificial
  Chemically synthesized
ugaccgagcaguuucugag

SEQ ID NO: 7409 - RNA, 19 nt, artificial
  Chemically synthesized
gagacauggaaacacaccc

SEQ ID NO: 7410 - RNA, 19 nt, artificial
  Chemically synthesized
ucauauuuccaguuuugac

SEQ ID NO: 7411 - RNA, 19 nt, artificial
  Chemically synthesized
uauguuucuggaaucaaga

SEQ ID NO: 7412 - RNA, 19 nt, artificial
  Chemically synthesized
uucuaaauucucccagaac

SEQ ID NO: 7413 - RNA, 19 nt, artificial
  Chemically synthesized
uuuaccauccagcagggcu

SEQ ID NO: 7414 - RNA, 19 nt, artificial
  Chemically synthesized
aucucuuuugucacaggag

SEQ ID NO: 7415 - RNA, 19 nt, artificial
  Chemically synthesized
aucaggugaaaauagaacu

SEQ ID NO: 7416 - RNA, 19 nt, artificial
  Chemically synthesized
cucauuucucccuuccucc

SEQ ID NO: 7417 - RNA, 19 nt, artificial
  Chemically synthesized
uuuguuggaagugaaagua

SEQ ID NO: 7418 - RNA, 19 nt, artificial
  Chemically synthesized
ucucccuaaagagauucag

SEQ ID NO: 7419 - RNA, 19 nt, artificial
  Chemically synthesized
acuucgagacuggacaagc

SEQ ID NO: 7420 - RNA, 19 nt, artificial
  Chemically synthesized
gaauacugaaaacucacuc

SEQ ID NO: 7421 - RNA, 19 nt, artificial
  Chemically synthesized
uucaauggucaaauugcac

SEQ ID NO: 7422 - RNA, 19 nt, artificial
  Chemically synthesized
uucaauugucuggauuuca

SEQ ID NO: 7423 - RNA, 19 nt, artificial
  Chemically synthesized
auucguucaacuuccacca

SEQ ID NO: 7424 - RNA, 19 nt, artificial
  Chemically synthesized
ugagguaagaguugaaaug

SEQ ID NO: 7425 - RNA, 19 nt, artificial
  Chemically synthesized
auauuaagguagagaggug

SEQ ID NO: 7426 - RNA, 19 nt, artificial
  Chemically synthesized
uucugaggcacuggugucu

SEQ ID NO: 7427 - RNA, 19 nt, artificial
  Chemically synthesized
ugcguggcucgcuaucacc

SEQ ID NO: 7428 - RNA, 19 nt, artificial
  Chemically synthesized
uuucacaccuccacgcagg

SEQ ID NO: 7429 - RNA, 19 nt, artificial
  Chemically synthesized
ucccuaaagagauucagag

SEQ ID NO: 7430 - RNA, 19 nt, artificial
  Chemically synthesized
uaaucacacucucuucuau

SEQ ID NO: 7431 - RNA, 19 nt, artificial
  Chemically synthesized
aacaaaggcaucauagaug

SEQ ID NO: 7432 - RNA, 19 nt, artificial
  Chemically synthesized
augcuagauuugucuccac

SEQ ID NO: 7433 - RNA, 19 nt, artificial
  Chemically synthesized
uacagauaugaucaugcgg

SEQ ID NO: 7434 - RNA, 19 nt, artificial
  Chemically synthesized
uuuccaguuuugacaacug

SEQ ID NO: 7435 - RNA, 19 nt, artificial
  Chemically synthesized
auaaagucucuguagugaa

SEQ ID NO: 7436 - RNA, 19 nt, artificial
  Chemically synthesized
uaucucuuuugucacagga

SEQ ID NO: 7437 - RNA, 19 nt, artificial
  Chemically synthesized
uugugagccacauuaaguu

SEQ ID NO: 7438 - RNA, 19 nt, artificial
  Chemically synthesized
aagaacaaugucucuuucu

SEQ ID NO: 7439 - RNA, 19 nt, artificial
  Chemically synthesized
ucaucucaaacagccauag

SEQ ID NO: 7440 - RNA, 19 nt, artificial
  Chemically synthesized
uacaagcacaagaguagag

SEQ ID NO: 7441 - RNA, 19 nt, artificial
  Chemically synthesized
caaauuauuucaaugcugc

SEQ ID NO: 7442 - RNA, 19 nt, artificial
  Chemically synthesized
uucaccucuaccauacuuu

SEQ ID NO: 7443 - RNA, 19 nt, artificial
  Chemically synthesized
uaguccagaaaaggcuccc

SEQ ID NO: 7444 - RNA, 19 nt, artificial
  Chemically synthesized
auugugagccacauuaagu

SEQ ID NO: 7445 - RNA, 19 nt, artificial
  Chemically synthesized
uuacccaguccucauccug

SEQ ID NO: 7446 - RNA, 19 nt, artificial
  Chemically synthesized
uuacucacccuuagcauaa

SEQ ID NO: 7447 - RNA, 19 nt, artificial
  Chemically synthesized
auauucaaagauacaccag

SEQ ID NO: 7448 - RNA, 19 nt, artificial
  Chemically synthesized
auaucaucgagguaguagu

SEQ ID NO: 7449 - RNA, 19 nt, artificial
  Chemically synthesized
auuaagguagagagguggc

SEQ ID NO: 7450 - RNA, 19 nt, artificial
  Chemically synthesized
aaaguucauaggguucagg

SEQ ID NO: 7451 - RNA, 19 nt, artificial
  Chemically synthesized
auuacucacccuuagcaua

SEQ ID NO: 7452 - RNA, 19 nt, artificial
  Chemically synthesized
cuuauaaggaaacguaucc

SEQ ID NO: 7453 - RNA, 19 nt, artificial
  Chemically synthesized
uagaaacucaaggcuuggu

SEQ ID NO: 7454 - RNA, 19 nt, artificial
  Chemically synthesized
acacauuguuuucucaaug

SEQ ID NO: 7455 - RNA, 19 nt, artificial
  Chemically synthesized
auagaccagaacugcuaca

SEQ ID NO: 7456 - RNA, 19 nt, artificial
  Chemically synthesized
auauuuaguaccugaagac

SEQ ID NO: 7457 - RNA, 19 nt, artificial
  Chemically synthesized
aaguucucuagagaugcua

SEQ ID NO: 7458 - RNA, 19 nt, artificial
  Chemically synthesized
uaugaucaugcggacacac

SEQ ID NO: 7459 - RNA, 19 nt, artificial
  Chemically synthesized
auugagacuguaaucaaga

SEQ ID NO: 7460 - RNA, 19 nt, artificial
  Chemically synthesized
ugaucaugcggacacacac

SEQ ID NO: 7461 - RNA, 19 nt, artificial
  Chemically synthesized
augacuuucuuugucaugg

SEQ ID NO: 7462 - RNA, 19 nt, artificial
  Chemically synthesized
acagucauuacuuaguagg

SEQ ID NO: 7463 - RNA, 19 nt, artificial
  Chemically synthesized
augauggucuuauucaucu

SEQ ID NO: 7464 - RNA, 19 nt, artificial
  Chemically synthesized
guugguugaaaugcccacc

SEQ ID NO: 7465 - RNA, 19 nt, artificial
  Chemically synthesized
auuucuuuaaaugcaccug

SEQ ID NO: 7466 - RNA, 19 nt, artificial
  Chemically synthesized
acaccgggaauaaagucuc

SEQ ID NO: 7467 - RNA, 19 nt, artificial
  Chemically synthesized
ugugaguaugagaaauguc

SEQ ID NO: 7468 - RNA, 19 nt, artificial
  Chemically synthesized
auucuuuacuagcucauuc

SEQ ID NO: 7469 - RNA, 19 nt, artificial
  Chemically synthesized
gagaucuagaaacucaagg

SEQ ID NO: 7470 - RNA, 19 nt, artificial
  Chemically synthesized
uuucugagucgucuccaga

SEQ ID NO: 7471 - RNA, 19 nt, artificial
  Chemically synthesized
aaggucaaguuucucagcu

SEQ ID NO: 7472 - RNA, 19 nt, artificial
  Chemically synthesized
ugaggcacuggugucuucu

SEQ ID NO: 7473 - RNA, 19 nt, artificial
  Chemically synthesized
uaggaauacugaaaacuca

SEQ ID NO: 7474 - RNA, 19 nt, artificial
  Chemically synthesized
uaguaccugaagacuggag

SEQ ID NO: 7475 - RNA, 19 nt, artificial
  Chemically synthesized
uaaaccagccagaccuuga

SEQ ID NO: 7476 - RNA, 19 nt, artificial
  Chemically synthesized
uacucacccuuagcauaag

SEQ ID NO: 7477 - RNA, 19 nt, artificial
  Chemically synthesized
uccuuuucuugaauguucu

SEQ ID NO: 7478 - RNA, 19 nt, artificial
  Chemically synthesized
augaacauucuuuucuggg

SEQ ID NO: 7479 - RNA, 19 nt, artificial
  Chemically synthesized
ugaaaugcccaccuggaag

SEQ ID NO: 7480 - RNA, 19 nt, artificial
  Chemically synthesized
aguaugagaaaugucaagg

SEQ ID NO: 7481 - RNA, 19 nt, artificial
  Chemically synthesized
uuaugugauugagacugua

SEQ ID NO: 7482 - RNA, 19 nt, artificial
  Chemically synthesized
ucacuuugagaacagcaac

SEQ ID NO: 7483 - RNA, 19 nt, artificial
  Chemically synthesized
cugaguugguugaaaugcc

SEQ ID NO: 7484 - RNA, 19 nt, artificial
  Chemically synthesized
uggugucuucucuuccucg

SEQ ID NO: 7485 - RNA, 19 nt, artificial
  Chemically synthesized
ugacagaguguacuuuucc

SEQ ID NO: 7486 - RNA, 19 nt, artificial
  Chemically synthesized
uuuccucuucagauagaug

SEQ ID NO: 7487 - RNA, 19 nt, artificial
  Chemically synthesized
cuagauuugucuccacagc

SEQ ID NO: 7488 - RNA, 19 nt, artificial
  Chemically synthesized
cauuaugugauugagacug

SEQ ID NO: 7489 - RNA, 19 nt, artificial
  Chemically synthesized
auaaucacacucucuucua

SEQ ID NO: 7490 - RNA, 19 nt, artificial
  Chemically synthesized
ucacacucucuucuauaca

SEQ ID NO: 7491 - RNA, 19 nt, artificial
  Chemically synthesized
acucacccuuagcauaagg

SEQ ID NO: 7492 - RNA, 19 nt, artificial
  Chemically synthesized
ucauggaugauguuggcag

SEQ ID NO: 7493 - RNA, 19 nt, artificial
  Chemically synthesized
auacacacagcccugauag

SEQ ID NO: 7494 - RNA, 19 nt, artificial
  Chemically synthesized
augccauugaaagcaacuc

SEQ ID NO: 7495 - RNA, 19 nt, artificial
  Chemically synthesized
aauagaacuuauagaccag

SEQ ID NO: 7496 - RNA, 19 nt, artificial
  Chemically synthesized
aacugcuacaacagauacu

SEQ ID NO: 7497 - RNA, 19 nt, artificial
  Chemically synthesized
auauucaaacucagcacag

SEQ ID NO: 7498 - RNA, 19 nt, artificial
  Chemically synthesized
cugagugauaggaauacug

SEQ ID NO: 7499 - RNA, 19 nt, artificial
  Chemically synthesized
ucgagaaugaccaggaugg

SEQ ID NO: 7500 - RNA, 19 nt, artificial
  Chemically synthesized
aacaugcucgagaaugacc

SEQ ID NO: 7501 - RNA, 19 nt, artificial
  Chemically synthesized
ucaaaccaaacacacucug

SEQ ID NO: 7502 - RNA, 19 nt, artificial
  Chemically synthesized
aacacacucugaaacacuc

SEQ ID NO: 7503 - RNA, 19 nt, artificial
  Chemically synthesized
ugccugagcagggucuucu

SEQ ID NO: 7504 - RNA, 19 nt, artificial
  Chemically synthesized
uucugaaaaagcauuccca

SEQ ID NO: 7505 - RNA, 19 nt, artificial
  Chemically synthesized
ucauuucaugaggucaccc

SEQ ID NO: 7506 - RNA, 19 nt, artificial
  Chemically synthesized
ugucuucucuuccucgagc

SEQ ID NO: 7507 - RNA, 19 nt, artificial
  Chemically synthesized
ugacugaguugguugaaau

SEQ ID NO: 7508 - RNA, 19 nt, artificial
  Chemically synthesized
uuucucagcucugugaaga

SEQ ID NO: 7509 - RNA, 19 nt, artificial
  Chemically synthesized
ucauagauguuuucaccuc

SEQ ID NO: 7510 - RNA, 19 nt, artificial
  Chemically synthesized
uucggcuuuuauggaaacc

SEQ ID NO: 7511 - RNA, 19 nt, artificial
  Chemically synthesized
agaaacugccaggucugag

SEQ ID NO: 7512 - RNA, 19 nt, artificial
  Chemically synthesized
agaacaaugucucuuucug

SEQ ID NO: 7513 - RNA, 19 nt, artificial
  Chemically synthesized
aauaacaccauugaagcuc

SEQ ID NO: 7514 - RNA, 19 nt, artificial
  Chemically synthesized
aggaaaagaacaaugucuc

SEQ ID NO: 7515 - RNA, 19 nt, artificial
  Chemically synthesized
aucuagaaacucaaggcuu

SEQ ID NO: 7516 - RNA, 19 nt, artificial
  Chemically synthesized
uggaugaacauucuuuucu

SEQ ID NO: 7517 - RNA, 19 nt, artificial
  Chemically synthesized
ucuaguuguucuaagccca

SEQ ID NO: 7518 - RNA, 19 nt, artificial
  Chemically synthesized
auggucaaauugcacaggc

SEQ ID NO: 7519 - RNA, 19 nt, artificial
  Chemically synthesized
ugauggucuuauucaucug

SEQ ID NO: 7520 - RNA, 19 nt, artificial
  Chemically synthesized
augacaucgagugacaaag

SEQ ID NO: 7521 - RNA, 19 nt, artificial
  Chemically synthesized
ucagcccauauguuucugg

SEQ ID NO: 7522 - RNA, 19 nt, artificial
  Chemically synthesized
aaugguuuuaugauggcua

SEQ ID NO: 7523 - RNA, 19 nt, artificial
  Chemically synthesized
uucuggaaucaagaaaagg

SEQ ID NO: 7524 - RNA, 19 nt, artificial
  Chemically synthesized
uuuucaagacuucgagacu

SEQ ID NO: 7525 - RNA, 19 nt, artificial
  Chemically synthesized
aucacacucucuucuauac

SEQ ID NO: 7526 - RNA, 19 nt, artificial
  Chemically synthesized
ucaaacuuuuccaaguuuc

SEQ ID NO: 7527 - RNA, 19 nt, artificial
  Chemically synthesized
ugugucucccuaaagagau

SEQ ID NO: 7528 - RNA, 19 nt, artificial
  Chemically synthesized
uuuacuagcucauuccuua

SEQ ID NO: 7529 - RNA, 19 nt, artificial
  Chemically synthesized
uucuccaccuucugcagga

SEQ ID NO: 7530 - RNA, 19 nt, artificial
  Chemically synthesized
agauuuaagaaagcuagac

SEQ ID NO: 7531 - RNA, 19 nt, artificial
  Chemically synthesized
uucgagacuggacaagcca

SEQ ID NO: 7532 - RNA, 19 nt, artificial
  Chemically synthesized
acacucaguaacaaacacu

SEQ ID NO: 7533 - RNA, 19 nt, artificial
  Chemically synthesized
aaaugucaagguaaaugag

SEQ ID NO: 7534 - RNA, 19 nt, artificial
  Chemically synthesized
aagcacaagaguagagaac

SEQ ID NO: 7535 - RNA, 19 nt, artificial
  Chemically synthesized
cucacccuuagcauaaggc

SEQ ID NO: 7536 - RNA, 19 nt, artificial
  Chemically synthesized
auguucaaucacccuagac

SEQ ID NO: 7537 - RNA, 19 nt, artificial
  Chemically synthesized
uuauagcuucauucagaca

SEQ ID NO: 7538 - RNA, 19 nt, artificial
  Chemically synthesized
auucccucugcacuggaag

SEQ ID NO: 7539 - RNA, 19 nt, artificial
  Chemically synthesized
uguggcucauauuuaguac

SEQ ID NO: 7540 - RNA, 19 nt, artificial
  Chemically synthesized
uguauucaaagcaguucug

SEQ ID NO: 7541 - RNA, 19 nt, artificial
  Chemically synthesized
ugagaucuagaaacucaag

SEQ ID NO: 7542 - RNA, 19 nt, artificial
  Chemically synthesized
auaaacuucugcugcaacu

SEQ ID NO: 7543 - RNA, 19 nt, artificial
  Chemically synthesized
auugguguauucaaagcag

SEQ ID NO: 7544 - RNA, 19 nt, artificial
  Chemically synthesized
uucccaccuuuguuggaag

SEQ ID NO: 7545 - RNA, 19 nt, artificial
  Chemically synthesized
auguauacucccugccuug

SEQ ID NO: 7546 - RNA, 19 nt, artificial
  Chemically synthesized
uuauggaaaccuucaugga

SEQ ID NO: 7547 - RNA, 19 nt, artificial
  Chemically synthesized
aaaucacuuugagaacagc

SEQ ID NO: 7548 - RNA, 19 nt, artificial
  Chemically synthesized
ugcucuagauuggucagau

SEQ ID NO: 7549 - RNA, 19 nt, artificial
  Chemically synthesized
ugagguuucugagugauag

SEQ ID NO: 7550 - RNA, 19 nt, artificial
  Chemically synthesized
gauuugucuccacagccac

SEQ ID NO: 7551 - RNA, 19 nt, artificial
  Chemically synthesized
augugauugagacuguaau

SEQ ID NO: 7552 - RNA, 19 nt, artificial
  Chemically synthesized
ugcuaaucggaauucuuca

SEQ ID NO: 7553 - RNA, 19 nt, artificial
  Chemically synthesized
uggaaaaugcuguaguucc

SEQ ID NO: 7554 - RNA, 19 nt, artificial
  Chemically synthesized
ucuaagcccaagaaguuug

SEQ ID NO: 7555 - RNA, 19 nt, artificial
  Chemically synthesized
ugagcagggucuucuccac

SEQ ID NO: 7556 - RNA, 19 nt, artificial
  Chemically synthesized
ucggcuuuuauggaaaccu

SEQ ID NO: 7557 - RNA, 19 nt, artificial
  Chemically synthesized
ugauauuagcuuauaggca

SEQ ID NO: 7558 - RNA, 19 nt, artificial
  Chemically synthesized
uguacaagcacaagaguag

SEQ ID NO: 7559 - RNA, 19 nt, artificial
  Chemically synthesized
guuuucucugucuuuauuc

SEQ ID NO: 7560 - RNA, 19 nt, artificial
  Chemically synthesized
auggcugggaucagagucc

SEQ ID NO: 7561 - RNA, 19 nt, artificial
  Chemically synthesized
uuggagacaacugcuccag

SEQ ID NO: 7562 - RNA, 19 nt, artificial
  Chemically synthesized
auauggauauuugaagcac

SEQ ID NO: 7563 - RNA, 19 nt, artificial
  Chemically synthesized
ucauuccuuacccaguccu

SEQ ID NO: 7564 - RNA, 19 nt, artificial
  Chemically synthesized
uaggguucagggacagguc

SEQ ID NO: 7565 - RNA, 19 nt, artificial
  Chemically synthesized
aacuucugcugcaacucau

SEQ ID NO: 7566 - RNA, 19 nt, artificial
  Chemically synthesized
uugcaggaaacucuggugu

SEQ ID NO: 7567 - RNA, 19 nt, artificial
  Chemically synthesized
acaaacacuucugacugug

SEQ ID NO: 7568 - RNA, 19 nt, artificial
  Chemically synthesized
aguggcuaaagaaacagca

SEQ ID NO: 7569 - RNA, 19 nt, artificial
  Chemically synthesized
gaaauauaaucacacucuc

SEQ ID NO: 7570 - RNA, 19 nt, artificial
  Chemically synthesized
ugagugauaggaauacuga

SEQ ID NO: 7571 - RNA, 19 nt, artificial
  Chemically synthesized
ucaguaacaaacacuucug

SEQ ID NO: 7572 - RNA, 19 nt, artificial
  Chemically synthesized
aacucaucucaaacagcca

SEQ ID NO: 7573 - RNA, 19 nt, artificial
  Chemically synthesized
aagaguugaaaugacuuuc

SEQ ID NO: 7574 - RNA, 19 nt, artificial
  Chemically synthesized
uguucuguuucugaggagg

SEQ ID NO: 7575 - RNA, 19 nt, artificial
  Chemically synthesized
ucaccuuucggcuuuuaug

SEQ ID NO: 7576 - RNA, 19 nt, artificial
  Chemically synthesized
ucuuuuacccuuucaauag

SEQ ID NO: 7577 - RNA, 19 nt, artificial
  Chemically synthesized
uucugagugauaggaauac

SEQ ID NO: 7578 - RNA, 19 nt, artificial
  Chemically synthesized
aacuugaugagguaagagu

SEQ ID NO: 7579 - RNA, 19 nt, artificial
  Chemically synthesized
uucaugacagucauuacuu

SEQ ID NO: 7580 - RNA, 19 nt, artificial
  Chemically synthesized
ugccauccgaaauuauaag

SEQ ID NO: 7581 - RNA, 19 nt, artificial
  Chemically synthesized
ugcaccauggaauuacuca

SEQ ID NO: 7582 - RNA, 19 nt, artificial
  Chemically synthesized
cuugaguagauaacaaagg

SEQ ID NO: 7583 - RNA, 19 nt, artificial
  Chemically synthesized
aauaccuucacacguaguu

SEQ ID NO: 7584 - RNA, 19 nt, artificial
  Chemically synthesized
cuauuuccucauuucuccc

SEQ ID NO: 7585 - RNA, 19 nt, artificial
  Chemically synthesized
guagagagguggcuuaggc

SEQ ID NO: 7586 - RNA, 19 nt, artificial
  Chemically synthesized
auuccuuacccaguccuca

SEQ ID NO: 7587 - RNA, 19 nt, artificial
  Chemically synthesized
acuuugagaacagcaaccu

SEQ ID NO: 7588 - RNA, 19 nt, artificial
  Chemically synthesized
agcuccuugagauuagcag

SEQ ID NO: 7589 - RNA, 19 nt, artificial
  Chemically synthesized
ugacuuucuuugucauggg

SEQ ID NO: 7590 - RNA, 19 nt, artificial
  Chemically synthesized
uagauuggucagauuagaa

SEQ ID NO: 7591 - RNA, 19 nt, artificial
  Chemically synthesized
ucgagugacaaagugacag

SEQ ID NO: 7592 - RNA, 19 nt, artificial
  Chemically synthesized
ugaagaugccauugaaagc

SEQ ID NO: 7593 - RNA, 19 nt, artificial
  Chemically synthesized
auuaacugaacaaguguug

SEQ ID NO: 7594 - RNA, 19 nt, artificial
  Chemically synthesized
auuguccuuuucuugaaug

SEQ ID NO: 7595 - RNA, 19 nt, artificial
  Chemically synthesized
uagccacuagacuuuaacc

SEQ ID NO: 7596 - RNA, 19 nt, artificial
  Chemically synthesized
agaaaugucaagguaaaug

SEQ ID NO: 7597 - RNA, 19 nt, artificial
  Chemically synthesized
ucagaaacugccaggucug

SEQ ID NO: 7598 - RNA, 19 nt, artificial
  Chemically synthesized
gaagcggaaauuuucuucc

SEQ ID NO: 7599 - RNA, 19 nt, artificial
  Chemically synthesized
ucuguuucugaggaggcug

SEQ ID NO: 7600 - RNA, 19 nt, artificial
  Chemically synthesized
auugccagccauuuucaag

SEQ ID NO: 7601 - RNA, 19 nt, artificial
  Chemically synthesized
ccuauuuccucauuucucc

SEQ ID NO: 7602 - RNA, 19 nt, artificial
  Chemically synthesized
aaucacccuagaccugcuc

SEQ ID NO: 7603 - RNA, 19 nt, artificial
  Chemically synthesized
aucaugcggacacacacac

SEQ ID NO: 7604 - RNA, 19 nt, artificial
  Chemically synthesized
uacccacuguuccuucugg

SEQ ID NO: 7605 - RNA, 19 nt, artificial
  Chemically synthesized
aacaaguguuggacccagc

SEQ ID NO: 7606 - RNA, 19 nt, artificial
  Chemically synthesized
uacccuuucaauagucaca

SEQ ID NO: 7607 - RNA, 19 nt, artificial
  Chemically synthesized
gaauaaagucucuguagug

SEQ ID NO: 7608 - RNA, 19 nt, artificial
  Chemically synthesized
aauaaagucucuguaguga

SEQ ID NO: 7609 - RNA, 19 nt, artificial
  Chemically synthesized
gucuucucuuccucgagcc

SEQ ID NO: 7610 - RNA, 19 nt, artificial
  Chemically synthesized
uugagauuagcagcccugc

SEQ ID NO: 7611 - RNA, 19 nt, artificial
  Chemically synthesized
uauacucccugccuugaau

SEQ ID NO: 7612 - RNA, 19 nt, artificial
  Chemically synthesized
auuuauucccucugcacug

SEQ ID NO: 7613 - RNA, 19 nt, artificial
  Chemically synthesized
aaugcuggaaauccagaug

SEQ ID NO: 7614 - RNA, 19 nt, artificial
  Chemically synthesized
uuucugggaaccuucuuua

SEQ ID NO: 7615 - RNA, 19 nt, artificial
  Chemically synthesized
auacagauaugaucaugcg

SEQ ID NO: 7616 - RNA, 19 nt, artificial
  Chemically synthesized
acacugaggaccgacacac

SEQ ID NO: 7617 - RNA, 19 nt, artificial
  Chemically synthesized
aagcggaaauuuucuuccc

SEQ ID NO: 7618 - RNA, 19 nt, artificial
  Chemically synthesized
uccuugagauuagcagccc

SEQ ID NO: 7619 - RNA, 19 nt, artificial
  Chemically synthesized
aucauagauguuuucaccu

SEQ ID NO: 7620 - RNA, 19 nt, artificial
  Chemically synthesized
auacugaaaacucacucau

SEQ ID NO: 7621 - RNA, 19 nt, artificial
  Chemically synthesized
aaaugguuuuaugauggcu

SEQ ID NO: 7622 - RNA, 19 nt, artificial
  Chemically synthesized
cuuauagaccagaacugcu

SEQ ID NO: 7623 - RNA, 19 nt, artificial
  Chemically synthesized
uugaauaccuucacacgua

SEQ ID NO: 7624 - RNA, 19 nt, artificial
  Chemically synthesized
uugugagcauguguuaauc

SEQ ID NO: 7625 - RNA, 19 nt, artificial
  Chemically synthesized
gauuggauaagauugugag

SEQ ID NO: 7626 - RNA, 19 nt, artificial
  Chemically synthesized
ucaagccauuucuacugag

SEQ ID NO: 7627 - RNA, 19 nt, artificial
  Chemically synthesized
uaaagggugagaggaagug

SEQ ID NO: 7628 - RNA, 19 nt, artificial
  Chemically synthesized
aaagaacaaugucucuuuc

SEQ ID NO: 7629 - RNA, 19 nt, artificial
  Chemically synthesized
agauguuuucaccucuacc

SEQ ID NO: 7630 - RNA, 19 nt, artificial
  Chemically synthesized
uuuggaagucauuauguga

SEQ ID NO: 7631 - RNA, 19 nt, artificial
  Chemically synthesized
uucaaucacccuagaccug

SEQ ID NO: 7632 - RNA, 19 nt, artificial
  Chemically synthesized
uucaaugcugcuuucauga

SEQ ID NO: 7633 - RNA, 19 nt, artificial
  Chemically synthesized
ucuuauucaucugacaggu

SEQ ID NO: 7634 - RNA, 19 nt, artificial
  Chemically synthesized
gauagauguugcuuccugc

SEQ ID NO: 7635 - RNA, 19 nt, artificial
  Chemically synthesized
aacgccugcagaccagugg

SEQ ID NO: 7636 - RNA, 19 nt, artificial
  Chemically synthesized
uguccaugauaagaccagg

SEQ ID NO: 7637 - RNA, 19 nt, artificial
  Chemically synthesized
auaacauccacucuuccca

SEQ ID NO: 7638 - RNA, 19 nt, artificial
  Chemically synthesized
aaugcacacaucuacuuuc

SEQ ID NO: 7639 - RNA, 19 nt, artificial
  Chemically synthesized
caugauaagaccaggaagc

SEQ ID NO: 7640 - RNA, 19 nt, artificial
  Chemically synthesized
caccauggaauuacucacc

SEQ ID NO: 7641 - RNA, 19 nt, artificial
  Chemically synthesized
uuuccauucaaaagacuca

SEQ ID NO: 7642 - RNA, 19 nt, artificial
  Chemically synthesized
acuuucacuaguacaugag

SEQ ID NO: 7643 - RNA, 19 nt, artificial
  Chemically synthesized
gaaagauuggauaagauug

SEQ ID NO: 7644 - RNA, 19 nt, artificial
  Chemically synthesized
aaagagagauugaguaggg

SEQ ID NO: 7645 - RNA, 19 nt, artificial
  Chemically synthesized
ucaaacagccauagacauc

SEQ ID NO: 7646 - RNA, 19 nt, artificial
  Chemically synthesized
acuaguacaugagacaugg

SEQ ID NO: 7647 - RNA, 19 nt, artificial
  Chemically synthesized
ucacacguaguucuccugg

SEQ ID NO: 7648 - RNA, 19 nt, artificial
  Chemically synthesized
uggcuaaagaaacagcaag

SEQ ID NO: 7649 - RNA, 19 nt, artificial
  Chemically synthesized
agcaguucugggcuaaagg

SEQ ID NO: 7650 - RNA, 19 nt, artificial
  Chemically synthesized
auuugaguuucaauguggg

SEQ ID NO: 7651 - RNA, 19 nt, artificial
  Chemically synthesized
aggaauacugaaaacucac

SEQ ID NO: 7652 - RNA, 19 nt, artificial
  Chemically synthesized
ugguagaucaacuucugaa

SEQ ID NO: 7653 - RNA, 19 nt, artificial
  Chemically synthesized
uuuuccucuucagauagau

SEQ ID NO: 7654 - RNA, 19 nt, artificial
  Chemically synthesized
aauaucaucgagguaguag

SEQ ID NO: 7655 - RNA, 19 nt, artificial
  Chemically synthesized
agaaagcuagacuacuugg

SEQ ID NO: 7656 - RNA, 19 nt, artificial
  Chemically synthesized
uucuguuuucucugucuuu

SEQ ID NO: 7657 - RNA, 19 nt, artificial
  Chemically synthesized
ggaaguucucuagagaugc

SEQ ID NO: 7658 - RNA, 19 nt, artificial
  Chemically synthesized
aauggucaaauugcacagg

SEQ ID NO: 7659 - RNA, 19 nt, artificial
  Chemically synthesized
aguugguugaaaugcccac

SEQ ID NO: 7660 - RNA, 19 nt, artificial
  Chemically synthesized
ugauguuggcagcaauggc

SEQ ID NO: 7661 - RNA, 19 nt, artificial
  Chemically synthesized
uaagccuuuugagagauuu

SEQ ID NO: 7662 - RNA, 19 nt, artificial
  Chemically synthesized
uugaagcacgucuuaaaca

SEQ ID NO: 7663 - RNA, 19 nt, artificial
  Chemically synthesized
gauuagaaaaauacucagg

SEQ ID NO: 7664 - RNA, 19 nt, artificial
  Chemically synthesized
aaacucaaggcuugguaga

SEQ ID NO: 7665 - RNA, 19 nt, artificial
  Chemically synthesized
ucaauggucaaauugcaca

SEQ ID NO: 7666 - RNA, 19 nt, artificial
  Chemically synthesized
agggucuucuccaccuucu

SEQ ID NO: 7667 - RNA, 19 nt, artificial
  Chemically synthesized
uugauaguccagaaaaggc

SEQ ID NO: 7668 - RNA, 19 nt, artificial
  Chemically synthesized
acuuuuccaaguuuccuuc

SEQ ID NO: 7669 - RNA, 19 nt, artificial
  Chemically synthesized
uuaccauccagcagggcuu

SEQ ID NO: 7670 - RNA, 19 nt, artificial
  Chemically synthesized
caggagaggaaguuagaag

SEQ ID NO: 7671 - RNA, 19 nt, artificial
  Chemically synthesized
auaggguucagggacaggu

SEQ ID NO: 7672 - RNA, 19 nt, artificial
  Chemically synthesized
aucaaacaucacuuguucu

SEQ ID NO: 7673 - RNA, 19 nt, artificial
  Chemically synthesized
aacagcaaccuuugaaacu

SEQ ID NO: 7674 - RNA, 19 nt, artificial
  Chemically synthesized
cgucuccagaagaugugcc

SEQ ID NO: 7675 - RNA, 19 nt, artificial
  Chemically synthesized
uugguguauucaaagcagu

SEQ ID NO: 7676 - RNA, 19 nt, artificial
  Chemically synthesized
gcaucuugcaucaggagcc

SEQ ID NO: 7677 - RNA, 19 nt, artificial
  Chemically synthesized
acuucuaaaccagccagac

SEQ ID NO: 7678 - RNA, 19 nt, artificial
  Chemically synthesized
auuuccucauuucucccuu

SEQ ID NO: 7679 - RNA, 19 nt, artificial
  Chemically synthesized
uugcacaggcccucuagag

SEQ ID NO: 7680 - RNA, 19 nt, artificial
  Chemically synthesized
agaaacucaaggcuuggua

SEQ ID NO: 7681 - RNA, 19 nt, artificial
  Chemically synthesized
ugcaggacaaugaagauga

SEQ ID NO: 7682 - RNA, 19 nt, artificial
  Chemically synthesized
cacuuugagaacagcaacc

SEQ ID NO: 7683 - RNA, 19 nt, artificial
  Chemically synthesized
aaacuucugcugcaacuca

SEQ ID NO: 7684 - RNA, 19 nt, artificial
  Chemically synthesized
ugauaagaccaggaagcgg

SEQ ID NO: 7685 - RNA, 19 nt, artificial
  Chemically synthesized
ugaagaugauaccagcacg

SEQ ID NO: 7686 - RNA, 19 nt, artificial
  Chemically synthesized
acaugcucgagaaugacca

SEQ ID NO: 7687 - RNA, 19 nt, artificial
  Chemically synthesized
guucuuucaaaguuuugag

SEQ ID NO: 7688 - RNA, 19 nt, artificial
  Chemically synthesized
aaagcggcaaccuuagcau

SEQ ID NO: 7689 - RNA, 19 nt, artificial
  Chemically synthesized
uaguucuccuggcagugag

SEQ ID NO: 7690 - RNA, 19 nt, artificial
  Chemically synthesized
uuaaccucuguaaggagac

SEQ ID NO: 7691 - RNA, 19 nt, artificial
  Chemically synthesized
agucucuguagugaaggca

SEQ ID NO: 7692 - RNA, 19 nt, artificial
  Chemically synthesized
uucccucugcacuggaagc

SEQ ID NO: 7693 - RNA, 19 nt, artificial
  Chemically synthesized
acucaaggcuugguagauc

SEQ ID NO: 7694 - RNA, 19 nt, artificial
  Chemically synthesized
aaaaggaaaaagugaacac

SEQ ID NO: 7695 - RNA, 19 nt, artificial
  Chemically synthesized
uugucauggguuccuugac

SEQ ID NO: 7696 - RNA, 19 nt, artificial
  Chemically synthesized
aaacugccaggucugagca

SEQ ID NO: 7697 - RNA, 19 nt, artificial
  Chemically synthesized
cucuucagauagauguugc

SEQ ID NO: 7698 - RNA, 19 nt, artificial
  Chemically synthesized
aagacucuguauuuuaguc

SEQ ID NO: 7699 - RNA, 19 nt, artificial
  Chemically synthesized
cuucuauacagauaugauc

SEQ ID NO: 7700 - RNA, 19 nt, artificial
  Chemically synthesized
uuggaagucauuaugugau

SEQ ID NO: 7701 - RNA, 19 nt, artificial
  Chemically synthesized
ucaaggagcauugcccaac

SEQ ID NO: 7702 - RNA, 19 nt, artificial
  Chemically synthesized
acugaacaaguguuggacc

SEQ ID NO: 7703 - RNA, 19 nt, artificial
  Chemically synthesized
aaggcucccagggcuaaac

SEQ ID NO: 7704 - RNA, 19 nt, artificial
  Chemically synthesized
ucauuucuaaauucuccca

SEQ ID NO: 7705 - RNA, 19 nt, artificial
  Chemically synthesized
ugauaacauccacucuucc

SEQ ID NO: 7706 - RNA, 19 nt, artificial
  Chemically synthesized
uuuauucaacuugaugagg

SEQ ID NO: 7707 - RNA, 19 nt, artificial
  Chemically synthesized
cauuucuaaauucucccag

SEQ ID NO: 7708 - RNA, 19 nt, artificial
  Chemically synthesized
uacuuuuccauacuuccuu

SEQ ID NO: 7709 - RNA, 19 nt, artificial
  Chemically synthesized
cuuguugcuggaaaggucc

SEQ ID NO: 7710 - RNA, 19 nt, artificial
  Chemically synthesized
agaucuaaauacuuuaggc

SEQ ID NO: 7711 - RNA, 19 nt, artificial
  Chemically synthesized
uaugugauugagacuguaa

SEQ ID NO: 7712 - RNA, 19 nt, artificial
  Chemically synthesized
aacaaugucucuuucuguu

SEQ ID NO: 7713 - RNA, 19 nt, artificial
  Chemically synthesized
auuguccaugauaagacca

SEQ ID NO: 7714 - RNA, 19 nt, artificial
  Chemically synthesized
ugaaaugacuuucuuuguc

SEQ ID NO: 7715 - RNA, 19 nt, artificial
  Chemically synthesized
uugaauguucuguuucuga

SEQ ID NO: 7716 - RNA, 19 nt, artificial
  Chemically synthesized
acuguggucauauuuccag

SEQ ID NO: 7717 - RNA, 19 nt, artificial
  Chemically synthesized
uguacccacuguuccuucu

SEQ ID NO: 7718 - RNA, 19 nt, artificial
  Chemically synthesized
acucaggaaaagaacaaug

SEQ ID NO: 7719 - RNA, 19 nt, artificial
  Chemically synthesized
auuuccaguuuugacaacu

SEQ ID NO: 7720 - RNA, 19 nt, artificial
  Chemically synthesized
cuuucuggucucacgcagg

SEQ ID NO: 7721 - RNA, 19 nt, artificial
  Chemically synthesized
cucuagagcagauuuguca

SEQ ID NO: 7722 - RNA, 19 nt, artificial
  Chemically synthesized
uuuucuucccguuuaaaag

SEQ ID NO: 7723 - RNA, 19 nt, artificial
  Chemically synthesized
gucucuuucuguuuucucu

SEQ ID NO: 7724 - RNA, 19 nt, artificial
  Chemically synthesized
augcuguuggagacaacug

SEQ ID NO: 7725 - RNA, 19 nt, artificial
  Chemically synthesized
acccuuucaauagucacac

SEQ ID NO: 7726 - RNA, 19 nt, artificial
  Chemically synthesized
ucuccuggcagugagaagg

SEQ ID NO: 7727 - RNA, 19 nt, artificial
  Chemically synthesized
acucagcacaggcaugccc

SEQ ID NO: 7728 - RNA, 19 nt, artificial
  Chemically synthesized
auuagcagcccugcauauc

SEQ ID NO: 7729 - RNA, 19 nt, artificial
  Chemically synthesized
aaugcuguuggagacaacu

SEQ ID NO: 7730 - RNA, 19 nt, artificial
  Chemically synthesized
auacauagggauaugugca

SEQ ID NO: 7731 - RNA, 19 nt, artificial
  Chemically synthesized
ucuuuugucacaggagagg

SEQ ID NO: 7732 - RNA, 19 nt, artificial
  Chemically synthesized
uuggaaugcuggaaaucca

SEQ ID NO: 7733 - RNA, 19 nt, artificial
  Chemically synthesized
uacucccugccuugaauac

SEQ ID NO: 7734 - RNA, 19 nt, artificial
  Chemically synthesized
cuucauucagacauaauug

SEQ ID NO: 7735 - RNA, 19 nt, artificial
  Chemically synthesized
uucugggcuaaagggugag

SEQ ID NO: 7736 - RNA, 19 nt, artificial
  Chemically synthesized
aaauucucccagaaccaaa

SEQ ID NO: 7737 - RNA, 19 nt, artificial
  Chemically synthesized
uggucaaauugcacaggcc

SEQ ID NO: 7738 - RNA, 19 nt, artificial
  Chemically synthesized
auaguccagaaaaggcucc

SEQ ID NO: 7739 - RNA, 19 nt, artificial
  Chemically synthesized
aauaaacuucugcugcaac

SEQ ID NO: 7740 - RNA, 19 nt, artificial
  Chemically synthesized
uauggaaaccuucauggau

SEQ ID NO: 7741 - RNA, 19 nt, artificial
  Chemically synthesized
uuccuggaaagaauugcca

SEQ ID NO: 7742 - RNA, 19 nt, artificial
  Chemically synthesized
aaccucuguaaggagacag

SEQ ID NO: 7743 - RNA, 19 nt, artificial
  Chemically synthesized
auuggauaagauugugagc

SEQ ID NO: 7744 - RNA, 19 nt, artificial
  Chemically synthesized
cgacugcucagaaacugcc

SEQ ID NO: 7745 - RNA, 19 nt, artificial
  Chemically synthesized
auuccauucguucaacuuc

SEQ ID NO: 7746 - RNA, 19 nt, artificial
  Chemically synthesized
guucaaucacccuagaccu

SEQ ID NO: 7747 - RNA, 19 nt, artificial
  Chemically synthesized
agugaaaguaagccuuuug

SEQ ID NO: 7748 - RNA, 19 nt, artificial
  Chemically synthesized
auaucuggaaggaaguuuu

SEQ ID NO: 7749 - RNA, 19 nt, artificial
  Chemically synthesized
ugagaggaagugaaagcgg

SEQ ID NO: 7750 - RNA, 19 nt, artificial
  Chemically synthesized
acagauacuacaagcacac

SEQ ID NO: 7751 - RNA, 19 nt, artificial
  Chemically synthesized
ucauuucucccuuccuccu

SEQ ID NO: 7752 - RNA, 19 nt, artificial
  Chemically synthesized
agcauucccaccuuuguug

SEQ ID NO: 7753 - RNA, 19 nt, artificial
  Chemically synthesized
gaaaccuucauggaugaug

SEQ ID NO: 7754 - RNA, 19 nt, artificial
  Chemically synthesized
agcaaucucauauucaaag

SEQ ID NO: 7755 - RNA, 19 nt, artificial
  Chemically synthesized
uguuccuucuggauuccau

SEQ ID NO: 7756 - RNA, 19 nt, artificial
  Chemically synthesized
aaauccagauguucuaguu

SEQ ID NO: 7757 - RNA, 19 nt, artificial
  Chemically synthesized
aauguauacucccugccuu

SEQ ID NO: 7758 - RNA, 19 nt, artificial
  Chemically synthesized
aaaagcauucccaccuuug

SEQ ID NO: 7759 - RNA, 19 nt, artificial
  Chemically synthesized
aacugcuccaguugacacu

SEQ ID NO: 7760 - RNA, 19 nt, artificial
  Chemically synthesized
acuggugucuucucuuccu

SEQ ID NO: 7761 - RNA, 19 nt, artificial
  Chemically synthesized
accaaugauggucuuauuc

SEQ ID NO: 7762 - RNA, 19 nt, artificial
  Chemically synthesized
uccaagugcucuagauugg

SEQ ID NO: 7763 - RNA, 19 nt, artificial
  Chemically synthesized
augucucuuucuguuuucu

SEQ ID NO: 7764 - RNA, 19 nt, artificial
  Chemically synthesized
ucugagucgucuccagaag

SEQ ID NO: 7765 - RNA, 19 nt, artificial
  Chemically synthesized
auugcauccuguacccacu

SEQ ID NO: 7766 - RNA, 19 nt, artificial
  Chemically synthesized
ucuuuucugggaaccuucu

SEQ ID NO: 7767 - RNA, 19 nt, artificial
  Chemically synthesized
acgucuuaaacaaccuuau

SEQ ID NO: 7768 - RNA, 19 nt, artificial
  Chemically synthesized
uucaucugacaggugauau

SEQ ID NO: 7769 - RNA, 19 nt, artificial
  Chemically synthesized
cuuccuugaaaaauagugg

SEQ ID NO: 7770 - RNA, 19 nt, artificial
  Chemically synthesized
uguugcuuccugccaauug

SEQ ID NO: 7771 - RNA, 19 nt, artificial
  Chemically synthesized
ucgucuccagaagaugugc

SEQ ID NO: 7772 - RNA, 19 nt, artificial
  Chemically synthesized
auuucuaaauucucccaga

SEQ ID NO: 7773 - RNA, 19 nt, artificial
  Chemically synthesized
acuacaagcacacugagga

SEQ ID NO: 7774 - RNA, 19 nt, artificial
  Chemically synthesized
uucuuugucauggguuccu

SEQ ID NO: 7775 - RNA, 19 nt, artificial
  Chemically synthesized
uguuguggcucauauuuag

SEQ ID NO: 7776 - RNA, 19 nt, artificial
  Chemically synthesized
ugagagagguccaggaagg

SEQ ID NO: 7777 - RNA, 19 nt, artificial
  Chemically synthesized
ugugagccacauuaaguuc

SEQ ID NO: 7778 - RNA, 19 nt, artificial
  Chemically synthesized
uuugaaacucaagccauuu

SEQ ID NO: 7779 - RNA, 19 nt, artificial
  Chemically synthesized
aggcacuggugucuucucu

SEQ ID NO: 7780 - RNA, 19 nt, artificial
  Chemically synthesized
gaugcuagauuugucucca

SEQ ID NO: 7781 - RNA, 19 nt, artificial
  Chemically synthesized
agguaguagucuaaguaug

SEQ ID NO: 7782 - RNA, 19 nt, artificial
  Chemically synthesized
uaaguaugcuaaucggaau

SEQ ID NO: 7783 - RNA, 19 nt, artificial
  Chemically synthesized
auuaugugauugagacugu

SEQ ID NO: 7784 - RNA, 19 nt, artificial
  Chemically synthesized
ugguccuugauccauugca

SEQ ID NO: 7785 - RNA, 19 nt, artificial
  Chemically synthesized
ugaauaccuucacacguag

SEQ ID NO: 7786 - RNA, 19 nt, artificial
  Chemically synthesized
uucuguuucugaggaggcu

SEQ ID NO: 7787 - RNA, 19 nt, artificial
  Chemically synthesized
agguccaucaaacaucacu

SEQ ID NO: 7788 - RNA, 19 nt, artificial
  Chemically synthesized
uagauguuuucaccucuac

SEQ ID NO: 7789 - RNA, 19 nt, artificial
  Chemically synthesized
accuucacacguaguucuc

SEQ ID NO: 7790 - RNA, 19 nt, artificial
  Chemically synthesized
uccuuccugccucuagccc

SEQ ID NO: 7791 - RNA, 19 nt, artificial
  Chemically synthesized
aacgauggacuucuaaacc

SEQ ID NO: 7792 - RNA, 19 nt, artificial
  Chemically synthesized
auaaggaaacguauccaau

SEQ ID NO: 7793 - RNA, 19 nt, artificial
  Chemically synthesized
accuuugaaacucaagcca

SEQ ID NO: 7794 - RNA, 19 nt, artificial
  Chemically synthesized
agccacauuaaguucuuuc

SEQ ID NO: 7795 - RNA, 19 nt, artificial
  Chemically synthesized
aacuuuuccaaguuuccuu

SEQ ID NO: 7796 - RNA, 19 nt, artificial
  Chemically synthesized
uucuuuaaaugcaccuggu

SEQ ID NO: 7797 - RNA, 19 nt, artificial
  Chemically synthesized
uggucuuauucaucugaca

SEQ ID NO: 7798 - RNA, 19 nt, artificial
  Chemically synthesized
aacuucugaaaaagcauuc

SEQ ID NO: 7799 - RNA, 19 nt, artificial
  Chemically synthesized
gaauuacucacccuuagca

SEQ ID NO: 7800 - RNA, 19 nt, artificial
  Chemically synthesized
ugcugcaacucauuucaug

SEQ ID NO: 7801 - RNA, 19 nt, artificial
  Chemically synthesized
augaagaugauaccagcac

SEQ ID NO: 7802 - RNA, 19 nt, artificial
  Chemically synthesized
aaacacucaguaacaaaca

SEQ ID NO: 7803 - RNA, 19 nt, artificial
  Chemically synthesized
agauuugucuccacagcca

SEQ ID NO: 7804 - RNA, 19 nt, artificial
  Chemically synthesized
aaaaauagaacaugcucga

SEQ ID NO: 7805 - RNA, 19 nt, artificial
  Chemically synthesized
cagcuuucuggucucacgc

SEQ ID NO: 7806 - RNA, 19 nt, artificial
  Chemically synthesized
agggcucccagcuuucugg

SEQ ID NO: 7807 - RNA, 19 nt, artificial
  Chemically synthesized
aaaaucacuuugagaacag

SEQ ID NO: 7808 - RNA, 19 nt, artificial
  Chemically synthesized
ugucaauauuaagguagag

SEQ ID NO: 7809 - RNA, 19 nt, artificial
  Chemically synthesized
caauauuaagguagagagg

SEQ ID NO: 7810 - RNA, 19 nt, artificial
  Chemically synthesized
gaaacucaaggcuugguag

SEQ ID NO: 7811 - RNA, 19 nt, artificial
  Chemically synthesized
cuucacacguaguucuccu

SEQ ID NO: 7812 - RNA, 19 nt, artificial
  Chemically synthesized
aguaacaaacacuucugac

SEQ ID NO: 7813 - RNA, 19 nt, artificial
  Chemically synthesized
agggcuaaacucuggaugg

SEQ ID NO: 7814 - RNA, 19 nt, artificial
  Chemically synthesized
aaauguugccauccgaaau

SEQ ID NO: 7815 - RNA, 19 nt, artificial
  Chemically synthesized
gaguagagaacucaucuca

SEQ ID NO: 7816 - RNA, 19 nt, artificial
  Chemically synthesized
aagcucagaucuaaauacu

SEQ ID NO: 7817 - RNA, 19 nt, artificial
  Chemically synthesized
auguggucaaggagcauug

SEQ ID NO: 7818 - RNA, 19 nt, artificial
  Chemically synthesized
uagauguugcuuccugcca

SEQ ID NO: 7819 - RNA, 19 nt, artificial
  Chemically synthesized
uacaccagcggcucuggau

SEQ ID NO: 7820 - RNA, 19 nt, artificial
  Chemically synthesized
ucauccucacugcuucugu

SEQ ID NO: 7821 - RNA, 19 nt, artificial
  Chemically synthesized
uaguuguucuaagcccaag

SEQ ID NO: 7822 - RNA, 19 nt, artificial
  Chemically synthesized
uuguggcucauauuuagua

SEQ ID NO: 7823 - RNA, 19 nt, artificial
  Chemically synthesized
agaaguuugaacucauggu

SEQ ID NO: 7824 - RNA, 19 nt, artificial
  Chemically synthesized
aacucugguguucacaagu

SEQ ID NO: 7825 - RNA, 19 nt, artificial
  Chemically synthesized
aagccuuuugagagauuug

SEQ ID NO: 7826 - RNA, 19 nt, artificial
  Chemically synthesized
ucugcugcaacucauuuca

SEQ ID NO: 7827 - RNA, 19 nt, artificial
  Chemically synthesized
uccauucaaaagacucagg

SEQ ID NO: 7828 - RNA, 19 nt, artificial
  Chemically synthesized
uagcuuauaggcaagacgu

SEQ ID NO: 7829 - RNA, 19 nt, artificial
  Chemically synthesized
gcaauguauacucccugcc

SEQ ID NO: 7830 - RNA, 19 nt, artificial
  Chemically synthesized
uccaggaaggucaaguuuc

SEQ ID NO: 7831 - RNA, 19 nt, artificial
  Chemically synthesized
uuccuuacccaguccucau

SEQ ID NO: 7832 - RNA, 19 nt, artificial
  Chemically synthesized
uuuauucccucugcacugg

SEQ ID NO: 7833 - RNA, 19 nt, artificial
  Chemically synthesized
aucuagugcaccauggaau

SEQ ID NO: 7834 - RNA, 19 nt, artificial
  Chemically synthesized
aagucauuaugugauugag

SEQ ID NO: 7835 - RNA, 19 nt, artificial
  Chemically synthesized
acacacagcccugauaggg

SEQ ID NO: 7836 - RNA, 19 nt, artificial
  Chemically synthesized
gcuugguagaucaacuucu

SEQ ID NO: 7837 - RNA, 19 nt, artificial
  Chemically synthesized
uuccuugaaaaauaguggu

SEQ ID NO: 7838 - RNA, 19 nt, artificial
  Chemically synthesized
uacauagggauaugugcac

SEQ ID NO: 7839 - RNA, 19 nt, artificial
  Chemically synthesized
uguuccugcugagaaggcg

SEQ ID NO: 7840 - RNA, 19 nt, artificial
  Chemically synthesized
ucuccaccuucugcaggac

SEQ ID NO: 7841 - RNA, 19 nt, artificial
  Chemically synthesized
uugucccaaaaucacuuug

SEQ ID NO: 7842 - RNA, 19 nt, artificial
  Chemically synthesized
uaaucagguuuccuuagga

SEQ ID NO: 7843 - RNA, 19 nt, artificial
  Chemically synthesized
cuggauuccaugauuuacc

SEQ ID NO: 7844 - RNA, 19 nt, artificial
  Chemically synthesized
acugcuacaacagauacua

SEQ ID NO: 7845 - RNA, 19 nt, artificial
  Chemically synthesized
acaugagacauggaaacac

SEQ ID NO: 7846 - RNA, 19 nt, artificial
  Chemically synthesized
aauuccagacacauuguuu

SEQ ID NO: 7847 - RNA, 19 nt, artificial
  Chemically synthesized
uucucagcucugugaagau

SEQ ID NO: 7848 - RNA, 19 nt, artificial
  Chemically synthesized
uuuacccuuucaauaguca

SEQ ID NO: 7849 - RNA, 19 nt, artificial
  Chemically synthesized
ucucuagagaugcuagauu

SEQ ID NO: 7850 - RNA, 19 nt, artificial
  Chemically synthesized
uucucccuuccuccuuuuc

SEQ ID NO: 7851 - RNA, 19 nt, artificial
  Chemically synthesized
uagcauucuggacuuuugu

SEQ ID NO: 7852 - RNA, 19 nt, artificial
  Chemically synthesized
cuuucuguuuucucugucu

SEQ ID NO: 7853 - RNA, 19 nt, artificial
  Chemically synthesized
aacacacccagggauguuc

SEQ ID NO: 7854 - RNA, 19 nt, artificial
  Chemically synthesized
ugaccaggaugguugugag

SEQ ID NO: 7855 - RNA, 19 nt, artificial
  Chemically synthesized
aagcaguucugggcuaaag

SEQ ID NO: 7856 - RNA, 19 nt, artificial
  Chemically synthesized
acuucugaaaaagcauucc

SEQ ID NO: 7857 - RNA, 19 nt, artificial
  Chemically synthesized
agagauucagagguccauc

SEQ ID NO: 7858 - RNA, 19 nt, artificial
  Chemically synthesized
gaucuagaaacucaaggcu

SEQ ID NO: 7859 - RNA, 19 nt, artificial
  Chemically synthesized
uuggaaaaugcuguaguuc

SEQ ID NO: 7860 - RNA, 19 nt, artificial
  Chemically synthesized
uaaauguugccauccgaaa

SEQ ID NO: 7861 - RNA, 19 nt, artificial
  Chemically synthesized
uugcauccuguacccacug

SEQ ID NO: 7862 - RNA, 19 nt, artificial
  Chemically synthesized
guaaucaagaaccuggagg

SEQ ID NO: 7863 - RNA, 19 nt, artificial
  Chemically synthesized
uuaauuccagacacauugu

SEQ ID NO: 7864 - RNA, 19 nt, artificial
  Chemically synthesized
aaggcgguacagcuccacc

SEQ ID NO: 7865 - RNA, 19 nt, artificial
  Chemically synthesized
ccuucauuucuaaauucuc

SEQ ID NO: 7866 - RNA, 19 nt, artificial
  Chemically synthesized
gggcauuugauguagaacc

SEQ ID NO: 7867 - RNA, 19 nt, artificial
  Chemically synthesized
cuucugaaaaagcauuccc

SEQ ID NO: 7868 - RNA, 19 nt, artificial
  Chemically synthesized
aucuaaauacuuuaggcug

SEQ ID NO: 7869 - RNA, 19 nt, artificial
  Chemically synthesized
aacucagcacaggcaugcc

SEQ ID NO: 7870 - RNA, 19 nt, artificial
  Chemically synthesized
uaugugcacaaaugcacac

SEQ ID NO: 7871 - RNA, 19 nt, artificial
  Chemically synthesized
accacaacaaucaccuuuc

SEQ ID NO: 7872 - RNA, 19 nt, artificial
  Chemically synthesized
uugccauccgaaauuauaa

SEQ ID NO: 7873 - RNA, 19 nt, artificial
  Chemically synthesized
uaucaccgucugaccgagc

SEQ ID NO: 7874 - RNA, 19 nt, artificial
  Chemically synthesized
cuuaugaagccuaauuucu

SEQ ID NO: 7875 - RNA, 19 nt, artificial
  Chemically synthesized
acugcagucaucaaguaga

SEQ ID NO: 7876 - RNA, 19 nt, artificial
  Chemically synthesized
ucauccuggcuugaguaga

SEQ ID NO: 7877 - RNA, 19 nt, artificial
  Chemically synthesized
caagcaaagucauucugag

SEQ ID NO: 7878 - RNA, 19 nt, artificial
  Chemically synthesized
aguuccuguuuuuuggaag

SEQ ID NO: 7879 - RNA, 19 nt, artificial
  Chemically synthesized
gguuccuugacugaguugg

SEQ ID NO: 7880 - RNA, 19 nt, artificial
  Chemically synthesized
agagaacucaucucaaaca

SEQ ID NO: 7881 - RNA, 19 nt, artificial
  Chemically synthesized
auaaggccugacauguggc

SEQ ID NO: 7882 - RNA, 19 nt, artificial
  Chemically synthesized
ucuaccauacuuuaugcag

SEQ ID NO: 7883 - RNA, 19 nt, artificial
  Chemically synthesized
augucaagguaaaugaggu

SEQ ID NO: 7884 - RNA, 19 nt, artificial
  Chemically synthesized
ucuaaagagagauugagua

SEQ ID NO: 7885 - RNA, 19 nt, artificial
  Chemically synthesized
ucgcuaucaccgucugacc

SEQ ID NO: 7886 - RNA, 19 nt, artificial
  Chemically synthesized
gauuuaagaaagcuagacu

SEQ ID NO: 7887 - RNA, 19 nt, artificial
  Chemically synthesized
ucccacuccagguaagugu

SEQ ID NO: 7888 - RNA, 19 nt, artificial
  Chemically synthesized
guguauucaaagcaguucu

SEQ ID NO: 7889 - RNA, 19 nt, artificial
  Chemically synthesized
uguggcagcauuuaauacu

SEQ ID NO: 7890 - RNA, 19 nt, artificial
  Chemically synthesized
uacccaguccucauccugg

SEQ ID NO: 7891 - RNA, 19 nt, artificial
  Chemically synthesized
aagaaaacgccugcagacc

SEQ ID NO: 7892 - RNA, 19 nt, artificial
  Chemically synthesized
gucaauaauaucaucgagg

SEQ ID NO: 7893 - RNA, 19 nt, artificial
  Chemically synthesized
uacuuugaaucuuguugcu

SEQ ID NO: 7894 - RNA, 19 nt, artificial
  Chemically synthesized
uggacuucuaaaccagcca

SEQ ID NO: 7895 - RNA, 19 nt, artificial
  Chemically synthesized
agcucugugaagauaucug

SEQ ID NO: 7896 - RNA, 19 nt, artificial
  Chemically synthesized
cacaaguacaagcaaaguc

SEQ ID NO: 7897 - RNA, 19 nt, artificial
  Chemically synthesized
uauucaucugacaggugau

SEQ ID NO: 7898 - RNA, 19 nt, artificial
  Chemically synthesized
cuucgagacuggacaagcc

SEQ ID NO: 7899 - RNA, 19 nt, artificial
  Chemically synthesized
ucaagaaaaggugaccucc

SEQ ID NO: 7900 - RNA, 19 nt, artificial
  Chemically synthesized
acacuucugacugugguca

SEQ ID NO: 7901 - RNA, 19 nt, artificial
  Chemically synthesized
uuucuggucucacgcagga

SEQ ID NO: 7902 - RNA, 19 nt, artificial
  Chemically synthesized
ugaguagauaacaaaggca

SEQ ID NO: 7903 - RNA, 19 nt, artificial
  Chemically synthesized
uucagagguccaucaaaca

SEQ ID NO: 7904 - RNA, 19 nt, artificial
  Chemically synthesized
ucuccagaagaugugccgc

SEQ ID NO: 7905 - RNA, 19 nt, artificial
  Chemically synthesized
caaguuucucagcucugug

SEQ ID NO: 7906 - RNA, 19 nt, artificial
  Chemically synthesized
ccuucacacguaguucucc

SEQ ID NO: 7907 - RNA, 19 nt, artificial
  Chemically synthesized
aaguuagaagaagaaaacg

SEQ ID NO: 7908 - RNA, 19 nt, artificial
  Chemically synthesized
cagggauguucaaucaccc

SEQ ID NO: 7909 - RNA, 19 nt, artificial
  Chemically synthesized
ugaggaggcuggaugaaca

SEQ ID NO: 7910 - RNA, 19 nt, artificial
  Chemically synthesized
caacaaucaccuuucggcu

SEQ ID NO: 7911 - RNA, 19 nt, artificial
  Chemically synthesized
aguuucugaggcacuggug

SEQ ID NO: 7912 - RNA, 19 nt, artificial
  Chemically synthesized
agaccuugaauacaaguuu

SEQ ID NO: 7913 - RNA, 19 nt, artificial
  Chemically synthesized
ucugguguucacaaguaca

SEQ ID NO: 7914 - RNA, 19 nt, artificial
  Chemically synthesized
uucaaacucagcacaggca

SEQ ID NO: 7915 - RNA, 19 nt, artificial
  Chemically synthesized
gagaugcuagauuugucuc

SEQ ID NO: 7916 - RNA, 19 nt, artificial
  Chemically synthesized
acagcaauguauacucccu

SEQ ID NO: 7917 - RNA, 19 nt, artificial
  Chemically synthesized
acacugagagagguccagg

SEQ ID NO: 7918 - RNA, 19 nt, artificial
  Chemically synthesized
ucacgcaggagaggaaggc

SEQ ID NO: 7919 - RNA, 19 nt, artificial
  Chemically synthesized
cuuccugccaauugcaucc

SEQ ID NO: 7920 - RNA, 19 nt, artificial
  Chemically synthesized
agcccaagaaguuugaacu

SEQ ID NO: 7921 - RNA, 19 nt, artificial
  Chemically synthesized
ucuaaguaugcuaaucgga

SEQ ID NO: 7922 - RNA, 19 nt, artificial
  Chemically synthesized
aaaccaaacacacucugaa

SEQ ID NO: 7923 - RNA, 19 nt, artificial
  Chemically synthesized
cauggaauuacucacccuu

SEQ ID NO: 7924 - RNA, 19 nt, artificial
  Chemically synthesized
augcucgagaaugaccagg

SEQ ID NO: 7925 - RNA, 19 nt, artificial
  Chemically synthesized
gaacuuauagaccagaacu

SEQ ID NO: 7926 - RNA, 19 nt, artificial
  Chemically synthesized
aacuguccaaauuuacagu

SEQ ID NO: 7927 - RNA, 19 nt, artificial
  Chemically synthesized
aggaauuagccacuagacu

SEQ ID NO: 7928 - RNA, 19 nt, artificial
  Chemically synthesized
guugaaaugacuuucuuug

SEQ ID NO: 7929 - RNA, 19 nt, artificial
  Chemically synthesized
uaagauugugagccacauu

SEQ ID NO: 7930 - RNA, 19 nt, artificial
  Chemically synthesized
auggaauuacucacccuua

SEQ ID NO: 7931 - RNA, 19 nt, artificial
  Chemically synthesized
guuccuucuggauuccaug

SEQ ID NO: 7932 - RNA, 19 nt, artificial
  Chemically synthesized
caagcauaagggauaaggg

SEQ ID NO: 7933 - RNA, 19 nt, artificial
  Chemically synthesized
ugaaaaagcauucccaccu

SEQ ID NO: 7934 - RNA, 19 nt, artificial
  Chemically synthesized
uuguuucaaauuggaaugc

SEQ ID NO: 7935 - RNA, 19 nt, artificial
  Chemically synthesized
aaagguccaagugcucuag

SEQ ID NO: 7936 - RNA, 19 nt, artificial
  Chemically synthesized
uaauuccagacacauuguu

SEQ ID NO: 7937 - RNA, 19 nt, artificial
  Chemically synthesized
acuggaagcuccuugagau

SEQ ID NO: 7938 - RNA, 19 nt, artificial
  Chemically synthesized
ugauugagacuguaaucaa

SEQ ID NO: 7939 - RNA, 19 nt, artificial
  Chemically synthesized
cacuccagguaaguguucc

SEQ ID NO: 7940 - RNA, 19 nt, artificial
  Chemically synthesized
uagaccugcucaaaccaaa

SEQ ID NO: 7941 - RNA, 19 nt, artificial
  Chemically synthesized
ugcugcuuucaugacaguc

SEQ ID NO: 7942 - RNA, 19 nt, artificial
  Chemically synthesized
aaaggcaucauagauguuu

SEQ ID NO: 7943 - RNA, 19 nt, artificial
  Chemically synthesized
auaacuuuggaaugacauc

SEQ ID NO: 7944 - RNA, 19 nt, artificial
  Chemically synthesized
caaugaagaugauaccagc

SEQ ID NO: 7945 - RNA, 19 nt, artificial
  Chemically synthesized
uuauucccucugcacugga

SEQ ID NO: 7946 - RNA, 19 nt, artificial
  Chemically synthesized
aacacucaguaacaaacac

SEQ ID NO: 7947 - RNA, 19 nt, artificial
  Chemically synthesized
auuucaaugcugcuuucau

SEQ ID NO: 7948 - RNA, 19 nt, artificial
  Chemically synthesized
acagauaugaucaugcgga

SEQ ID NO: 7949 - RNA, 19 nt, artificial
  Chemically synthesized
ccuuucaauagucacacuc

SEQ ID NO: 7950 - RNA, 19 nt, artificial
  Chemically synthesized
uucuccuggcagugagaag

SEQ ID NO: 7951 - RNA, 19 nt, artificial
  Chemically synthesized
gauccauugcaggaaacuc

SEQ ID NO: 7952 - RNA, 19 nt, artificial
  Chemically synthesized
uggaaugacaucgagugac

SEQ ID NO: 7953 - RNA, 19 nt, artificial
  Chemically synthesized
augagacauggaaacacac

SEQ ID NO: 7954 - RNA, 19 nt, artificial
  Chemically synthesized
aaugauaacauccacucuu

SEQ ID NO: 7955 - RNA, 19 nt, artificial
  Chemically synthesized
aagauugugagccacauua

SEQ ID NO: 7956 - RNA, 19 nt, artificial
  Chemically synthesized
acuguuccuucuggauucc

SEQ ID NO: 7957 - RNA, 19 nt, artificial
  Chemically synthesized
ggaauuacucacccuuagc

SEQ ID NO: 7958 - RNA, 19 nt, artificial
  Chemically synthesized
caggucuaaagagagauug

SEQ ID NO: 7959 - RNA, 19 nt, artificial
  Chemically synthesized
caagugcucuagauugguc

SEQ ID NO: 7960 - RNA, 19 nt, artificial
  Chemically synthesized
uccagguaaguguuccugc

SEQ ID NO: 7961 - RNA, 19 nt, artificial
  Chemically synthesized
cuucuaaaccagccagacc

SEQ ID NO: 7962 - RNA, 19 nt, artificial
  Chemically synthesized
uaguacaugagacauggaa

SEQ ID NO: 7963 - RNA, 19 nt, artificial
  Chemically synthesized
aagauuggauaagauugug

SEQ ID NO: 7964 - RNA, 19 nt, artificial
  Chemically synthesized
uucaaaguuuugagauguc

SEQ ID NO: 7965 - RNA, 19 nt, artificial
  Chemically synthesized
uugcuggaaagguccaagu

SEQ ID NO: 7966 - RNA, 19 nt, artificial
  Chemically synthesized
auucucccagaaccaaacg

SEQ ID NO: 7967 - RNA, 19 nt, artificial
  Chemically synthesized
ucugagugauaggaauacu

SEQ ID NO: 7968 - RNA, 19 nt, artificial
  Chemically synthesized
acaaaugcacacaucuacu

SEQ ID NO: 7969 - RNA, 19 nt, artificial
  Chemically synthesized
ucucaaugauaacauccac

SEQ ID NO: 7970 - RNA, 19 nt, artificial
  Chemically synthesized
acauucuuuucugggaacc

SEQ ID NO: 7971 - RNA, 19 nt, artificial
  Chemically synthesized
acacucucuucuauacaga

SEQ ID NO: 7972 - RNA, 19 nt, artificial
  Chemically synthesized
acaccaaugauggucuuau

SEQ ID NO: 7973 - RNA, 19 nt, artificial
  Chemically synthesized
uugccagccauuuucaaga

SEQ ID NO: 7974 - RNA, 19 nt, artificial
  Chemically synthesized
ugauccauugcaggaaacu

SEQ ID NO: 7975 - RNA, 19 nt, artificial
  Chemically synthesized
ucaaguuucucagcucugu

SEQ ID NO: 7976 - RNA, 19 nt, artificial
  Chemically synthesized
aggugauauucaaacucag

SEQ ID NO: 7977 - RNA, 19 nt, artificial
  Chemically synthesized
uuguccuuuucuugaaugu

SEQ ID NO: 7978 - RNA, 19 nt, artificial
  Chemically synthesized
ucuggaaucaagaaaaggu

SEQ ID NO: 7979 - RNA, 19 nt, artificial
  Chemically synthesized
guauucaaagcaguucugg

SEQ ID NO: 7980 - RNA, 19 nt, artificial
  Chemically synthesized
ugguugucccaaaaucacu

SEQ ID NO: 7981 - RNA, 19 nt, artificial
  Chemically synthesized
uaaacuugauaguccagaa

SEQ ID NO: 7982 - RNA, 19 nt, artificial
  Chemically synthesized
cuuccuuccugccucuagc

SEQ ID NO: 7983 - RNA, 19 nt, artificial
  Chemically synthesized
aggaaggucaaguuucuca

SEQ ID NO: 7984 - RNA, 19 nt, artificial
  Chemically synthesized
ccuucauggaugauguugg

SEQ ID NO: 7985 - RNA, 19 nt, artificial
  Chemically synthesized
cuugguagaucaacuucug

SEQ ID NO: 7986 - RNA, 19 nt, artificial
  Chemically synthesized
aaagcuagacuacuuggaa

SEQ ID NO: 7987 - RNA, 19 nt, artificial
  Chemically synthesized
caaagauacaccagcggcu

SEQ ID NO: 7988 - RNA, 19 nt, artificial
  Chemically synthesized
agaccagaacugcuacaac

SEQ ID NO: 7989 - RNA, 19 nt, artificial
  Chemically synthesized
acugcucagaaacugccag

SEQ ID NO: 7990 - RNA, 19 nt, artificial
  Chemically synthesized
uccaccaagagcugccucu

SEQ ID NO: 7991 - RNA, 19 nt, artificial
  Chemically synthesized
cacacuuucaaauacacac

SEQ ID NO: 7992 - RNA, 19 nt, artificial
  Chemically synthesized
cuuugaaucuuguugcugg

SEQ ID NO: 7993 - RNA, 19 nt, artificial
  Chemically synthesized
gaaacacucaguaacaaac

SEQ ID NO: 7994 - RNA, 19 nt, artificial
  Chemically synthesized
auuuuuccucuucagauag

SEQ ID NO: 7995 - RNA, 19 nt, artificial
  Chemically synthesized
ucuacuuucacuaguacau

SEQ ID NO: 7996 - RNA, 19 nt, artificial
  Chemically synthesized
aacucaaggcuugguagau

SEQ ID NO: 7997 - RNA, 19 nt, artificial
  Chemically synthesized
acaagcacacugaggaccg

SEQ ID NO: 7998 - RNA, 19 nt, artificial
  Chemically synthesized
caaccuuagcauucuggac

SEQ ID NO: 7999 - RNA, 19 nt, artificial
  Chemically synthesized
acuuucaaauacacacagc

SEQ ID NO: 8000 - RNA, 19 nt, artificial
  Chemically synthesized
uugauccauugcaggaaac

SEQ ID NO: 8001 - RNA, 19 nt, artificial
  Chemically synthesized
ugauaggaauacugaaaac

SEQ ID NO: 8002 - RNA, 19 nt, artificial
  Chemically synthesized
accagaacugcuacaacag

SEQ ID NO: 8003 - RNA, 19 nt, artificial
  Chemically synthesized
agagagguggcuuaggcuc

SEQ ID NO: 8004 - RNA, 19 nt, artificial
  Chemically synthesized
ugcccugcuuaucugaagg

SEQ ID NO: 8005 - RNA, 19 nt, artificial
  Chemically synthesized
ucuucaauugucuggauuu

SEQ ID NO: 8006 - RNA, 19 nt, artificial
  Chemically synthesized
ucauuaugugauugagacu

SEQ ID NO: 8007 - RNA, 19 nt, artificial
  Chemically synthesized
gaaccuucuuuauaagaac

SEQ ID NO: 8008 - RNA, 19 nt, artificial
  Chemically synthesized
gucuccacagccaccagcu

SEQ ID NO: 8009 - RNA, 19 nt, artificial
  Chemically synthesized
ugggcuaaagggugagagg

SEQ ID NO: 8010 - RNA, 19 nt, artificial
  Chemically synthesized
gacaccacaacaaucaccu

SEQ ID NO: 8011 - RNA, 19 nt, artificial
  Chemically synthesized
aggucaucccacuuccuuc

SEQ ID NO: 8012 - RNA, 19 nt, artificial
  Chemically synthesized
aucggaauucuucaauggu

SEQ ID NO: 8013 - RNA, 19 nt, artificial
  Chemically synthesized
aagccauugaagaugccau

SEQ ID NO: 8014 - RNA, 19 nt, artificial
  Chemically synthesized
aagcacacugaggaccgac

SEQ ID NO: 8015 - RNA, 19 nt, artificial
  Chemically synthesized
acuacuuggaaaaugcugu

SEQ ID NO: 8016 - RNA, 19 nt, artificial
  Chemically synthesized
aggucaaguuucucagcuc

SEQ ID NO: 8017 - RNA, 19 nt, artificial
  Chemically synthesized
ucaaauacacacagcccug

SEQ ID NO: 8018 - RNA, 19 nt, artificial
  Chemically synthesized
ugugaagauaucuggaagg

SEQ ID NO: 8019 - RNA, 19 nt, artificial
  Chemically synthesized
aaagagauucagaggucca

SEQ ID NO: 8020 - RNA, 19 nt, artificial
  Chemically synthesized
agugaguuaaaugcuguug

SEQ ID NO: 8021 - RNA, 19 nt, artificial
  Chemically synthesized
aaaugcaccugguuggaua

SEQ ID NO: 8022 - RNA, 19 nt, artificial
  Chemically synthesized
uauuuaguaccugaagacu

SEQ ID NO: 8023 - RNA, 19 nt, artificial
  Chemically synthesized
cuacugagaucuagaaacu

SEQ ID NO: 8024 - RNA, 19 nt, artificial
  Chemically synthesized
uugcuuccugccaauugca

SEQ ID NO: 8025 - RNA, 19 nt, artificial
  Chemically synthesized
uccagaagaugugccgccc

SEQ ID NO: 8026 - RNA, 19 nt, artificial
  Chemically synthesized
ucuaaauacuuuaggcugg

SEQ ID NO: 8027 - RNA, 19 nt, artificial
  Chemically synthesized
gauggcuauaacauaauac

SEQ ID NO: 8028 - RNA, 19 nt, artificial
  Chemically synthesized
cagagguccaucaaacauc

SEQ ID NO: 8029 - RNA, 19 nt, artificial
  Chemically synthesized
caaugugggaaacugucca

SEQ ID NO: 8030 - RNA, 19 nt, artificial
  Chemically synthesized
uuuuccaaguuuccuucau

SEQ ID NO: 8031 - RNA, 19 nt, artificial
  Chemically synthesized
uguuucaaauuggaaugcu

SEQ ID NO: 8032 - RNA, 19 nt, artificial
  Chemically synthesized
aauguugccauccgaaauu

SEQ ID NO: 8033 - RNA, 19 nt, artificial
  Chemically synthesized
ugaacucaugguaauaaca

SEQ ID NO: 8034 - RNA, 19 nt, artificial
  Chemically synthesized
ucaugcggacacacacacu

SEQ ID NO: 8035 - RNA, 19 nt, artificial
  Chemically synthesized
aaugacuuucuuugucaug

SEQ ID NO: 8036 - RNA, 19 nt, artificial
  Chemically synthesized
ggucagauuagaaaaauac

SEQ ID NO: 8037 - RNA, 19 nt, artificial
  Chemically synthesized
ucuggacuuuuguuucucu

SEQ ID NO: 8038 - RNA, 19 nt, artificial
  Chemically synthesized
ugcaccugguuggauaaag

SEQ ID NO: 8039 - RNA, 19 nt, artificial
  Chemically synthesized
accugcucaaaccaaacac

SEQ ID NO: 8040 - RNA, 19 nt, artificial
  Chemically synthesized
acacuuauaaggaaacgua

SEQ ID NO: 8041 - RNA, 19 nt, artificial
  Chemically synthesized
auuagcuuauaggcaagac

SEQ ID NO: 8042 - RNA, 19 nt, artificial
  Chemically synthesized
ucucacgcaggagaggaag

SEQ ID NO: 8043 - RNA, 19 nt, artificial
  Chemically synthesized
aaugcccaccuggaagacu

SEQ ID NO: 8044 - RNA, 19 nt, artificial
  Chemically synthesized
uuccuugacugaguugguu

SEQ ID NO: 8045 - RNA, 19 nt, artificial
  Chemically synthesized
ggaaggucaaguuucucag

SEQ ID NO: 8046 - RNA, 19 nt, artificial
  Chemically synthesized
agugauaggaauacugaaa

SEQ ID NO: 8047 - RNA, 19 nt, artificial
  Chemically synthesized
accuucugcaggacaauga

SEQ ID NO: 8048 - RNA, 19 nt, artificial
  Chemically synthesized
uuuccaaguuuccuucauu

SEQ ID NO: 8049 - RNA, 19 nt, artificial
  Chemically synthesized
uagaacuuauagaccagaa

SEQ ID NO: 8050 - RNA, 19 nt, artificial
  Chemically synthesized
acacucugaaacacucagu

SEQ ID NO: 8051 - RNA, 19 nt, artificial
  Chemically synthesized
ucugaaaaagcauucccac

SEQ ID NO: 8052 - RNA, 19 nt, artificial
  Chemically synthesized
ugcuccaguugacacugag

SEQ ID NO: 8053 - RNA, 19 nt, artificial
  Chemically synthesized
cuuaggcucugauaugccc

SEQ ID NO: 8054 - RNA, 19 nt, artificial
  Chemically synthesized
gugaguuaaaugcuguugg

SEQ ID NO: 8055 - RNA, 19 nt, artificial
  Chemically synthesized
uugguagaucaacuucuga

SEQ ID NO: 8056 - RNA, 19 nt, artificial
  Chemically synthesized
ucucuuuugucacaggaga

SEQ ID NO: 8057 - RNA, 19 nt, artificial
  Chemically synthesized
gaaguuagaagaagaaaac

SEQ ID NO: 8058 - RNA, 19 nt, artificial
  Chemically synthesized
gagaacucaucucaaacag

SEQ ID NO: 8059 - RNA, 19 nt, artificial
  Chemically synthesized
aagucauucugaguaagau

SEQ ID NO: 8060 - RNA, 19 nt, artificial
  Chemically synthesized
auggguuccuugacugagu

SEQ ID NO: 8061 - RNA, 19 nt, artificial
  Chemically synthesized
acuuugaaucuuguugcug

SEQ ID NO: 8062 - RNA, 19 nt, artificial
  Chemically synthesized
ucugguccuugauccauug

SEQ ID NO: 8063 - RNA, 19 nt, artificial
  Chemically synthesized
ucguucaacuuccaccaag

SEQ ID NO: 8064 - RNA, 19 nt, artificial
  Chemically synthesized
guuaucucuuuugucacag

SEQ ID NO: 8065 - RNA, 19 nt, artificial
  Chemically synthesized
uugucaaacuuuuccaagu

SEQ ID NO: 8066 - RNA, 19 nt, artificial
  Chemically synthesized
ucaacuucugaaaaagcau

SEQ ID NO: 8067 - RNA, 19 nt, artificial
  Chemically synthesized
uuccaguuuugacaacuga

SEQ ID NO: 8068 - RNA, 19 nt, artificial
  Chemically synthesized
aagacucaggaaaagaaca

SEQ ID NO: 8069 - RNA, 19 nt, artificial
  Chemically synthesized
auccacucuucccaaaaug

SEQ ID NO: 8070 - RNA, 19 nt, artificial
  Chemically synthesized
agaggaaguuagaagaaga

SEQ ID NO: 8071 - RNA, 19 nt, artificial
  Chemically synthesized
caacugaauuuuguugucu

SEQ ID NO: 8072 - RNA, 19 nt, artificial
  Chemically synthesized
aagaccaggaagcggaaau

SEQ ID NO: 8073 - RNA, 19 nt, artificial
  Chemically synthesized
acaagcacaagaguagaga

SEQ ID NO: 8074 - RNA, 19 nt, artificial
  Chemically synthesized
cacacucucuucuauacag

SEQ ID NO: 8075 - RNA, 19 nt, artificial
  Chemically synthesized
aaugcguggcucgcuauca

SEQ ID NO: 8076 - RNA, 19 nt, artificial
  Chemically synthesized
ugcacaggcccucuagagc

SEQ ID NO: 8077 - RNA, 19 nt, artificial
  Chemically synthesized
cauugcaggaaacucuggu

SEQ ID NO: 8078 - RNA, 19 nt, artificial
  Chemically synthesized
ucuugaauguucuguuucu

SEQ ID NO: 8079 - RNA, 19 nt, artificial
  Chemically synthesized
aaaaagugaacacccaguu

SEQ ID NO: 8080 - RNA, 19 nt, artificial
  Chemically synthesized
accgacacaccaaugaugg

SEQ ID NO: 8081 - RNA, 19 nt, artificial
  Chemically synthesized
ugugggaaacuguccaaau

SEQ ID NO: 8082 - RNA, 19 nt, artificial
  Chemically synthesized
uuuucaccucuaccauacu

SEQ ID NO: 8083 - RNA, 19 nt, artificial
  Chemically synthesized
ugugaaugcguggcucgcu

SEQ ID NO: 8084 - RNA, 19 nt, artificial
  Chemically synthesized
aaacuuuuccaaguuuccu

SEQ ID NO: 8085 - RNA, 19 nt, artificial
  Chemically synthesized
auguguuaaucagguuucc

SEQ ID NO: 8086 - RNA, 19 nt, artificial
  Chemically synthesized
uuugauguagaacccgcaa

SEQ ID NO: 8087 - RNA, 19 nt, artificial
  Chemically synthesized
auaaaguucauaggguuca

SEQ ID NO: 8088 - RNA, 19 nt, artificial
  Chemically synthesized
ugggacaccacaacaauca

SEQ ID NO: 8089 - RNA, 19 nt, artificial
  Chemically synthesized
auuccagacacauuguuuu

SEQ ID NO: 8090 - RNA, 19 nt, artificial
  Chemically synthesized
agaacugcuacaacagaua

SEQ ID NO: 8091 - RNA, 19 nt, artificial
  Chemically synthesized
ugcaacucauuucaugagg

SEQ ID NO: 8092 - RNA, 19 nt, artificial
  Chemically synthesized
ucuggucucacgcaggaga

SEQ ID NO: 8093 - RNA, 19 nt, artificial
  Chemically synthesized
gauaugugcacaaaugcac

SEQ ID NO: 8094 - RNA, 19 nt, artificial
  Chemically synthesized
cugauagggauacauaggg

SEQ ID NO: 8095 - RNA, 19 nt, artificial
  Chemically synthesized
ucaucgagguaguagucua

SEQ ID NO: 8096 - RNA, 19 nt, artificial
  Chemically synthesized
aucuggaaggaaguuuucc

SEQ ID NO: 8097 - RNA, 19 nt, artificial
  Chemically synthesized
ucugacuguggucauauuu

SEQ ID NO: 8098 - RNA, 19 nt, artificial
  Chemically synthesized
ugauagggauacauaggga

SEQ ID NO: 8099 - RNA, 19 nt, artificial
  Chemically synthesized
gcuucuguaaacuugauag

SEQ ID NO: 8100 - RNA, 19 nt, artificial
  Chemically synthesized
augauaacauccacucuuc

SEQ ID NO: 8101 - RNA, 19 nt, artificial
  Chemically synthesized
gucauuaugugauugagac

SEQ ID NO: 8102 - RNA, 19 nt, artificial
  Chemically synthesized
cauaucuagugcaccaugg

SEQ ID NO: 8103 - RNA, 19 nt, artificial
  Chemically synthesized
ugucauggguuccuugacu

SEQ ID NO: 8104 - RNA, 19 nt, artificial
  Chemically synthesized
uuccaccaagagcugccuc

SEQ ID NO: 8105 - RNA, 19 nt, artificial
  Chemically synthesized
acuuuaugcagccagcaag

SEQ ID NO: 8106 - RNA, 19 nt, artificial
  Chemically synthesized
gcaucauagauguuuucac

SEQ ID NO: 8107 - RNA, 19 nt, artificial
  Chemically synthesized
cuccuugagauuagcagcc

SEQ ID NO: 8108 - RNA, 19 nt, artificial
  Chemically synthesized
ugggaucagagucccagcc

SEQ ID NO: 8109 - RNA, 19 nt, artificial
  Chemically synthesized
gcaccauggaauuacucac

SEQ ID NO: 8110 - RNA, 19 nt, artificial
  Chemically synthesized
accaaacacacucugaaac

SEQ ID NO: 8111 - RNA, 19 nt, artificial
  Chemically synthesized
gauaggaauacugaaaacu

SEQ ID NO: 8112 - RNA, 19 nt, artificial
  Chemically synthesized
ugcccaacaggaaacagca

SEQ ID NO: 8113 - RNA, 19 nt, artificial
  Chemically synthesized
guucuaguuguucuaagcc

SEQ ID NO: 8114 - RNA, 19 nt, artificial
  Chemically synthesized
auucuuuucugggaaccuu

SEQ ID NO: 8115 - RNA, 19 nt, artificial
  Chemically synthesized
agaguugaaaugacuuucu

SEQ ID NO: 8116 - RNA, 19 nt, artificial
  Chemically synthesized
uauuugaagcacgucuuaa

SEQ ID NO: 8117 - RNA, 19 nt, artificial
  Chemically synthesized
caauggucaaauugcacag

SEQ ID NO: 8118 - RNA, 19 nt, artificial
  Chemically synthesized
auuucucccuuccuccuuu

SEQ ID NO: 8119 - RNA, 19 nt, artificial
  Chemically synthesized
uuagcauaaggccugacau

SEQ ID NO: 8120 - RNA, 19 nt, artificial
  Chemically synthesized
uucacaccuccacgcaggg

SEQ ID NO: 8121 - RNA, 19 nt, artificial
  Chemically synthesized
ugguguucacaaguacaag

SEQ ID NO: 8122 - RNA, 19 nt, artificial
  Chemically synthesized
ugguugaaaugcccaccug

SEQ ID NO: 8123 - RNA, 19 nt, artificial
  Chemically synthesized
aaacaucacuuguucugaa

SEQ ID NO: 8124 - RNA, 19 nt, artificial
  Chemically synthesized
aucaacuucugaaaaagca

SEQ ID NO: 8125 - RNA, 19 nt, artificial
  Chemically synthesized
caucccacuuccuuccugc

SEQ ID NO: 8126 - RNA, 19 nt, artificial
  Chemically synthesized
acaggaaacagcaauguau

SEQ ID NO: 8127 - RNA, 19 nt, artificial
  Chemically synthesized
agugcucuagauuggucag

SEQ ID NO: 8128 - RNA, 19 nt, artificial
  Chemically synthesized
acaacagauacuacaagca

SEQ ID NO: 8129 - RNA, 19 nt, artificial
  Chemically synthesized
ucuagagaugcuagauuug

SEQ ID NO: 8130 - RNA, 19 nt, artificial
  Chemically synthesized
ucuaaauguugccauccga

SEQ ID NO: 8131 - RNA, 19 nt, artificial
  Chemically synthesized
acacucaccagggaaaaug

SEQ ID NO: 8132 - RNA, 19 nt, artificial
  Chemically synthesized
accagcuucuguaaacuug

SEQ ID NO: 8133 - RNA, 19 nt, artificial
  Chemically synthesized
accgggaauaaagucucug

SEQ ID NO: 8134 - RNA, 19 nt, artificial
  Chemically synthesized
agacauggaaacacaccca

SEQ ID NO: 8135 - RNA, 19 nt, artificial
  Chemically synthesized
auguucuguuucugaggag

SEQ ID NO: 8136 - RNA, 19 nt, artificial
  Chemically synthesized
ugaaagcaacucuggugug

SEQ ID NO: 8137 - RNA, 19 nt, artificial
  Chemically synthesized
uaacaaaggcaucauagau

SEQ ID NO: 8138 - RNA, 19 nt, artificial
  Chemically synthesized
uggauuucacaccuccacg

SEQ ID NO: 8139 - RNA, 19 nt, artificial
  Chemically synthesized
uuguuguggcucauauuua

SEQ ID NO: 8140 - RNA, 19 nt, artificial
  Chemically synthesized
accugguuggauaaaguuc

SEQ ID NO: 8141 - RNA, 19 nt, artificial
  Chemically synthesized
ucuggaaggaaguuuuccu

SEQ ID NO: 8142 - RNA, 19 nt, artificial
  Chemically synthesized
agcacaagaguagagaacu

SEQ ID NO: 8143 - RNA, 19 nt, artificial
  Chemically synthesized
gaauguucuguuucugagg

SEQ ID NO: 8144 - RNA, 19 nt, artificial
  Chemically synthesized
uuucugagugauaggaaua

SEQ ID NO: 8145 - RNA, 19 nt, artificial
  Chemically synthesized
aucacuuugagaacagcaa

SEQ ID NO: 8146 - RNA, 19 nt, artificial
  Chemically synthesized
aaagcauucccaccuuugu

SEQ ID NO: 8147 - RNA, 19 nt, artificial
  Chemically synthesized
ggaggcuggaugaacauuc

SEQ ID NO: 8148 - RNA, 19 nt, artificial
  Chemically synthesized
uacacacagcccugauagg

SEQ ID NO: 8149 - RNA, 19 nt, artificial
  Chemically synthesized
agaacagcaaccuuugaaa

SEQ ID NO: 8150 - RNA, 19 nt, artificial
  Chemically synthesized
cauauucaaagauacacca

SEQ ID NO: 8151 - RNA, 19 nt, artificial
  Chemically synthesized
cagggcuaaacucuggaug

SEQ ID NO: 8152 - RNA, 19 nt, artificial
  Chemically synthesized
acagccaccagcuucugua

SEQ ID NO: 8153 - RNA, 19 nt, artificial
  Chemically synthesized
gucuuauucaucugacagg

SEQ ID NO: 8154 - RNA, 19 nt, artificial
  Chemically synthesized
caauuagacaacucccuau

SEQ ID NO: 8155 - RNA, 19 nt, artificial
  Chemically synthesized
auuugaagcacgucuuaaa

SEQ ID NO: 8156 - RNA, 19 nt, artificial
  Chemically synthesized
aagccauuucuacugagau

SEQ ID NO: 8157 - RNA, 19 nt, artificial
  Chemically synthesized
uccacagccaccagcuucu

SEQ ID NO: 8158 - RNA, 19 nt, artificial
  Chemically synthesized
ugcacuggaagcuccuuga

SEQ ID NO: 8159 - RNA, 19 nt, artificial
  Chemically synthesized
caauagucacacucaccag

SEQ ID NO: 8160 - RNA, 19 nt, artificial
  Chemically synthesized
auacucccugccuugaaua

SEQ ID NO: 8161 - RNA, 19 nt, artificial
  Chemically synthesized
aaguuucucagcucuguga

SEQ ID NO: 8162 - RNA, 19 nt, artificial
  Chemically synthesized
ugcucgagaaugaccagga

SEQ ID NO: 8163 - RNA, 19 nt, artificial
  Chemically synthesized
caaacuuuuccaaguuucc

SEQ ID NO: 8164 - RNA, 19 nt, artificial
  Chemically synthesized
auccagauguucuaguugu

SEQ ID NO: 8165 - RNA, 19 nt, artificial
  Chemically synthesized
augcccugcuuaucugaag

SEQ ID NO: 8166 - RNA, 19 nt, artificial
  Chemically synthesized
aaguuguuguggcucauau

SEQ ID NO: 8167 - RNA, 19 nt, artificial
  Chemically synthesized
gauaugaucaugcggacac

SEQ ID NO: 8168 - RNA, 19 nt, artificial
  Chemically synthesized
ugucuggauuucacaccuc

SEQ ID NO: 8169 - RNA, 19 nt, artificial
  Chemically synthesized
aguaccugaagacuggaga

SEQ ID NO: 8170 - RNA, 19 nt, artificial
  Chemically synthesized
guggcucauauuuaguacc

SEQ ID NO: 8171 - RNA, 19 nt, artificial
  Chemically synthesized
uacuuaguaggcaauaacu

SEQ ID NO: 8172 - RNA, 19 nt, artificial
  Chemically synthesized
uggaaugcuggaaauccag

SEQ ID NO: 8173 - RNA, 19 nt, artificial
  Chemically synthesized
aaaagugaacacccaguuc

SEQ ID NO: 8174 - RNA, 19 nt, artificial
  Chemically synthesized
caucaaacaucacuuguuc

SEQ ID NO: 8175 - RNA, 19 nt, artificial
  Chemically synthesized
augauaagaccaggaagcg

SEQ ID NO: 8176 - RNA, 19 nt, artificial
  Chemically synthesized
uucugagucgucuccagaa

SEQ ID NO: 8177 - RNA, 19 nt, artificial
  Chemically synthesized
ugaaaacucacucauuugu

SEQ ID NO: 8178 - RNA, 19 nt, artificial
  Chemically synthesized
agcacgucuuaaacaaccu

SEQ ID NO: 8179 - RNA, 19 nt, artificial
  Chemically synthesized
agcaauguauacucccugc

SEQ ID NO: 8180 - RNA, 19 nt, artificial
  Chemically synthesized
acugcuucugugagcagca

SEQ ID NO: 8181 - RNA, 19 nt, artificial
  Chemically synthesized
gaagcucagaucuaaauac

SEQ ID NO: 8182 - RNA, 19 nt, artificial
  Chemically synthesized
cauucuggacuuuuguuuc

SEQ ID NO: 8183 - RNA, 19 nt, artificial
  Chemically synthesized
ucauccuggcaucauccuc

SEQ ID NO: 8184 - RNA, 19 nt, artificial
  Chemically synthesized
caucgagugacaaagugac

SEQ ID NO: 8185 - RNA, 19 nt, artificial
  Chemically synthesized
uuuugucacaggagaggaa

SEQ ID NO: 8186 - RNA, 19 nt, artificial
  Chemically synthesized
cucucuucuauacagauau

SEQ ID NO: 8187 - RNA, 19 nt, artificial
  Chemically synthesized
ucugagcaaucucauauuc

SEQ ID NO: 8188 - RNA, 19 nt, artificial
  Chemically synthesized
ucaauaauaucaucgaggu

SEQ ID NO: 8189 - RNA, 19 nt, artificial
  Chemically synthesized
cugugcaauaaauacuuug

SEQ ID NO: 8190 - RNA, 19 nt, artificial
  Chemically synthesized
accuugaauacaaguuuuc

SEQ ID NO: 8191 - RNA, 19 nt, artificial
  Chemically synthesized
gccuugaauaccuucacac

SEQ ID NO: 8192 - RNA, 19 nt, artificial
  Chemically synthesized
auccugauuguccuuuucu

SEQ ID NO: 8193 - RNA, 19 nt, artificial
  Chemically synthesized
gauugagacuguaaucaag

SEQ ID NO: 8194 - RNA, 19 nt, artificial
  Chemically synthesized
acaagcaaagucauucuga

SEQ ID NO: 8195 - RNA, 19 nt, artificial
  Chemically synthesized
acauggaaacacacccagg

SEQ ID NO: 8196 - RNA, 19 nt, artificial
  Chemically synthesized
uacugaaaacucacucauu

SEQ ID NO: 8197 - RNA, 19 nt, artificial
  Chemically synthesized
aaagucauucugaguaaga

SEQ ID NO: 8198 - RNA, 19 nt, artificial
  Chemically synthesized
aagaaaagucuuuuacccu

SEQ ID NO: 8199 - RNA, 19 nt, artificial
  Chemically synthesized
aucuucaauugucuggauu

SEQ ID NO: 8200 - RNA, 19 nt, artificial
  Chemically synthesized
aucauccucacugcuucug

SEQ ID NO: 8201 - RNA, 19 nt, artificial
  Chemically synthesized
aagucuuuuacccuuucaa

SEQ ID NO: 8202 - RNA, 19 nt, artificial
  Chemically synthesized
caaggcuugguagaucaac

SEQ ID NO: 8203 - RNA, 19 nt, artificial
  Chemically synthesized
ccagccaucugugucuccc

SEQ ID NO: 8204 - RNA, 19 nt, artificial
  Chemically synthesized
cauuucuacugagaucuag

SEQ ID NO: 8205 - RNA, 19 nt, artificial
  Chemically synthesized
ugaccuccugaggucaucc

SEQ ID NO: 8206 - RNA, 19 nt, artificial
  Chemically synthesized
aaucuuguugcuggaaagg

SEQ ID NO: 8207 - RNA, 19 nt, artificial
  Chemically synthesized
augaccaggaugguuguga

SEQ ID NO: 8208 - RNA, 19 nt, artificial
  Chemically synthesized
guugcuuccugccaauugc

SEQ ID NO: 8209 - RNA, 19 nt, artificial
  Chemically synthesized
aucccacuuccuuccugcc

SEQ ID NO: 8210 - RNA, 19 nt, artificial
  Chemically synthesized
uguugcacauuccauucgu

SEQ ID NO: 8211 - RNA, 19 nt, artificial
  Chemically synthesized
uccuggaaagaauugccag

SEQ ID NO: 8212 - RNA, 19 nt, artificial
  Chemically synthesized
aaacgccugcagaccagug

SEQ ID NO: 8213 - RNA, 19 nt, artificial
  Chemically synthesized
ugaagugcugggacaccac

SEQ ID NO: 8214 - RNA, 19 nt, artificial
  Chemically synthesized
aauagaacaugcucgagaa

SEQ ID NO: 8215 - RNA, 19 nt, artificial
  Chemically synthesized
gauuugucaaacuuuucca

SEQ ID NO: 8216 - RNA, 19 nt, artificial
  Chemically synthesized
uccuuaggaauuagccacu

SEQ ID NO: 8217 - RNA, 19 nt, artificial
  Chemically synthesized
aaucaagaaaaggugaccu

SEQ ID NO: 8218 - RNA, 19 nt, artificial
  Chemically synthesized
cacccagggauguucaauc

SEQ ID NO: 8219 - RNA, 19 nt, artificial
  Chemically synthesized
aucaucgagguaguagucu

SEQ ID NO: 8220 - RNA, 19 nt, artificial
  Chemically synthesized
uaaauucucccagaaccaa

SEQ ID NO: 8221 - RNA, 19 nt, artificial
  Chemically synthesized
ucucuucuauacagauaug

SEQ ID NO: 8222 - RNA, 19 nt, artificial
  Chemically synthesized
aaaagacucaggaaaagaa

SEQ ID NO: 8223 - RNA, 19 nt, artificial
  Chemically synthesized
ggauauuugaagcacgucu

SEQ ID NO: 8224 - RNA, 19 nt, artificial
  Chemically synthesized
cuucuccaccuucugcagg

SEQ ID NO: 8225 - RNA, 19 nt, artificial
  Chemically synthesized
auagaacuuauagaccaga

SEQ ID NO: 8226 - RNA, 19 nt, artificial
  Chemically synthesized
augagguaagaguugaaau

SEQ ID NO: 8227 - RNA, 19 nt, artificial
  Chemically synthesized
aaacguauccaaugaaaag

SEQ ID NO: 8228 - RNA, 19 nt, artificial
  Chemically synthesized
acauuccauucguucaacu

SEQ ID NO: 8229 - RNA, 19 nt, artificial
  Chemically synthesized
ugaaggcagagcugaaaug

SEQ ID NO: 8230 - RNA, 19 nt, artificial
  Chemically synthesized
auugcccaacaggaaacag

SEQ ID NO: 8231 - RNA, 19 nt, artificial
  Chemically synthesized
cacuguuccuucuggauuc

SEQ ID NO: 8232 - RNA, 19 nt, artificial
  Chemically synthesized
ucaaugcugcuuucaugac

SEQ ID NO: 8233 - RNA, 19 nt, artificial
  Chemically synthesized
guuggauaaaguucauagg

SEQ ID NO: 8234 - RNA, 19 nt, artificial
  Chemically synthesized
uacuuggaaaaugcuguag

SEQ ID NO: 8235 - RNA, 19 nt, artificial
  Chemically synthesized
gcuagauuugucuccacag

SEQ ID NO: 8236 - RNA, 19 nt, artificial
  Chemically synthesized
ucccucugcacuggaagcu

SEQ ID NO: 8237 - RNA, 19 nt, artificial
  Chemically synthesized
uccuguacccacuguuccu

SEQ ID NO: 8238 - RNA, 19 nt, artificial
  Chemically synthesized
uugaugagguaagaguuga

SEQ ID NO: 8239 - RNA, 19 nt, artificial
  Chemically synthesized
cacucuucccaaaaugugg

SEQ ID NO: 8240 - RNA, 19 nt, artificial
  Chemically synthesized
uuucuggaaucaagaaaag

SEQ ID NO: 8241 - RNA, 19 nt, artificial
  Chemically synthesized
gaacagcaaccuuugaaac

SEQ ID NO: 8242 - RNA, 19 nt, artificial
  Chemically synthesized
ucuguagugaaggcagagc

SEQ ID NO: 8243 - RNA, 19 nt, artificial
  Chemically synthesized
aagcuccuugagauuagca

SEQ ID NO: 8244 - RNA, 19 nt, artificial
  Chemically synthesized
acucaugguaauaacacca

SEQ ID NO: 8245 - RNA, 19 nt, artificial
  Chemically synthesized
uacuuucacuaguacauga

SEQ ID NO: 8246 - RNA, 19 nt, artificial
  Chemically synthesized
aauacuuuaggcugguugu

SEQ ID NO: 8247 - RNA, 19 nt, artificial
  Chemically synthesized
aucuacuuucacuaguaca

SEQ ID NO: 8248 - RNA, 19 nt, artificial
  Chemically synthesized
agauuggauaagauuguga

SEQ ID NO: 8249 - RNA, 19 nt, artificial
  Chemically synthesized
cucauauucaaagauacac

SEQ ID NO: 8250 - RNA, 19 nt, artificial
  Chemically synthesized
cacaccuccacgcagggcu

SEQ ID NO: 8251 - RNA, 19 nt, artificial
  Chemically synthesized
gauuugaguuucaaugugg

SEQ ID NO: 8252 - RNA, 19 nt, artificial
  Chemically synthesized
uugacugaguugguugaaa

SEQ ID NO: 8253 - RNA, 19 nt, artificial
  Chemically synthesized
aauguggucaaggagcauu

SEQ ID NO: 8254 - RNA, 19 nt, artificial
  Chemically synthesized
uuugaaucuuguugcugga

SEQ ID NO: 8255 - RNA, 19 nt, artificial
  Chemically synthesized
ucuucucuuccucgagccg

SEQ ID NO: 8256 - RNA, 19 nt, artificial
  Chemically synthesized
caaacacuucugacugugg

SEQ ID NO: 8257 - RNA, 19 nt, artificial
  Chemically synthesized
agguguugcacauuccauu

SEQ ID NO: 8258 - RNA, 19 nt, artificial
  Chemically synthesized
caaagugacagaguguacu

SEQ ID NO: 8259 - RNA, 19 nt, artificial
  Chemically synthesized
cuuuucuugaauguucugu

SEQ ID NO: 8260 - RNA, 19 nt, artificial
  Chemically synthesized
acaacugaauuuuguuguc

SEQ ID NO: 8261 - RNA, 19 nt, artificial
  Chemically synthesized
ucuuaaagucagcuuauga

SEQ ID NO: 8262 - RNA, 19 nt, artificial
  Chemically synthesized
auuagacaacucccuauuu

SEQ ID NO: 8263 - RNA, 19 nt, artificial
  Chemically synthesized
gaucuaaauacuuuaggcu

SEQ ID NO: 8264 - RNA, 19 nt, artificial
  Chemically synthesized
gucaaaacuaccaaaaugg

SEQ ID NO: 8265 - RNA, 19 nt, artificial
  Chemically synthesized
gauacuacaagcacacuga

SEQ ID NO: 8266 - RNA, 19 nt, artificial
  Chemically synthesized
gaacaaugucucuuucugu

SEQ ID NO: 8267 - RNA, 19 nt, artificial
  Chemically synthesized
gucucuguagugaaggcag

SEQ ID NO: 8268 - RNA, 19 nt, artificial
  Chemically synthesized
aagugaacacccaguucag

SEQ ID NO: 8269 - RNA, 19 nt, artificial
  Chemically synthesized
aaagucuuuuacccuuuca

SEQ ID NO: 8270 - RNA, 19 nt, artificial
  Chemically synthesized
gauaacauccacucuuccc

SEQ ID NO: 8271 - RNA, 19 nt, artificial
  Chemically synthesized
gagcagggucuucuccacc

SEQ ID NO: 8272 - RNA, 19 nt, artificial
  Chemically synthesized
gauguuggcagcaauggcc

SEQ ID NO: 8273 - RNA, 19 nt, artificial
  Chemically synthesized
uuucucccuuccuccuuuu

SEQ ID NO: 8274 - RNA, 19 nt, artificial
  Chemically synthesized
ugugagcauguguuaauca

SEQ ID NO: 8275 - RNA, 19 nt, artificial
  Chemically synthesized
aaaagaaguuguuguggcu

SEQ ID NO: 8276 - RNA, 19 nt, artificial
  Chemically synthesized
gauaagaccaggaagcgga

SEQ ID NO: 8277 - RNA, 19 nt, artificial
  Chemically synthesized
agacuguaaucaagaaccu

SEQ ID NO: 8278 - RNA, 19 nt, artificial
  Chemically synthesized
gauacauagggauaugugc

SEQ ID NO: 8279 - RNA, 19 nt, artificial
  Chemically synthesized
ugaacacccaguucaguca

SEQ ID NO: 8280 - RNA, 19 nt, artificial
  Chemically synthesized
acucaucucaaacagccau

SEQ ID NO: 8281 - RNA, 19 nt, artificial
  Chemically synthesized
uuccagacacauuguuuuc

SEQ ID NO: 8282 - RNA, 19 nt, artificial
  Chemically synthesized
uugaagcucagaucuaaau

SEQ ID NO: 8283 - RNA, 19 nt, artificial
  Chemically synthesized
acaaugucucuuucuguuu

SEQ ID NO: 8284 - RNA, 19 nt, artificial
  Chemically synthesized
uggcugggaucagaguccc

SEQ ID NO: 8285 - RNA, 19 nt, artificial
  Chemically synthesized
cuuauuaacugaacaagug

SEQ ID NO: 8286 - RNA, 19 nt, artificial
  Chemically synthesized
augguugugagcauguguu

SEQ ID NO: 8287 - RNA, 19 nt, artificial
  Chemically synthesized
uuaggcugguugucccaaa

SEQ ID NO: 8288 - RNA, 19 nt, artificial
  Chemically synthesized
cugcacuggaagcuccuug

SEQ ID NO: 8289 - RNA, 19 nt, artificial
  Chemically synthesized
gugauauucaaacucagca

SEQ ID NO: 8290 - RNA, 19 nt, artificial
  Chemically synthesized
cuuuguuggaagugaaagu

SEQ ID NO: 8291 - RNA, 19 nt, artificial
  Chemically synthesized
gugauugagacuguaauca

SEQ ID NO: 8292 - RNA, 19 nt, artificial
  Chemically synthesized
aagaagaaaacgccugcag

SEQ ID NO: 8293 - RNA, 19 nt, artificial
  Chemically synthesized
cuggaaagaauugccagcc

SEQ ID NO: 8294 - RNA, 19 nt, artificial
  Chemically synthesized
acuuuuccauacuuccuug

SEQ ID NO: 8295 - RNA, 19 nt, artificial
  Chemically synthesized
acccuuagcauaaggccug

SEQ ID NO: 8296 - RNA, 19 nt, artificial
  Chemically synthesized
aucuuguugcuggaaaggu

SEQ ID NO: 8297 - RNA, 19 nt, artificial
  Chemically synthesized
uggcuuaggcucugauaug

SEQ ID NO: 8298 - RNA, 19 nt, artificial
  Chemically synthesized
aaaauagaacaugcucgag

SEQ ID NO: 8299 - RNA, 19 nt, artificial
  Chemically synthesized
uaugagaaaugucaaggua

SEQ ID NO: 8300 - RNA, 19 nt, artificial
  Chemically synthesized
aaaauguggucaaggagca

SEQ ID NO: 8301 - RNA, 19 nt, artificial
  Chemically synthesized
gucuccagaagaugugccg

SEQ ID NO: 8302 - RNA, 19 nt, artificial
  Chemically synthesized
guaauaacaccauugaagc

SEQ ID NO: 8303 - RNA, 19 nt, artificial
  Chemically synthesized
agguccaggaaggucaagu

SEQ ID NO: 8304 - RNA, 19 nt, artificial
  Chemically synthesized
guaacaaacacuucugacu

SEQ ID NO: 8305 - RNA, 19 nt, artificial
  Chemically synthesized
guaugcuaaucggaauucu

SEQ ID NO: 8306 - RNA, 19 nt, artificial
  Chemically synthesized
uaccugaagacuggagagu

SEQ ID NO: 8307 - RNA, 19 nt, artificial
  Chemically synthesized
agaaccuggagggaguuca

SEQ ID NO: 8308 - RNA, 19 nt, artificial
  Chemically synthesized
aacagauacuacaagcaca

SEQ ID NO: 8309 - RNA, 19 nt, artificial
  Chemically synthesized
uauucaacuugaugaggua

SEQ ID NO: 8310 - RNA, 19 nt, artificial
  Chemically synthesized
aucgagguaguagucuaag

SEQ ID NO: 8311 - RNA, 19 nt, artificial
  Chemically synthesized
ugcucaaaccaaacacacu

SEQ ID NO: 8312 - RNA, 19 nt, artificial
  Chemically synthesized
auccagcagggcuuuucug

SEQ ID NO: 8313 - RNA, 19 nt, artificial
  Chemically synthesized
auaugugcacaaaugcaca

SEQ ID NO: 8314 - RNA, 19 nt, artificial
  Chemically synthesized
gacacaccaaugauggucu

SEQ ID NO: 8315 - RNA, 19 nt, artificial
  Chemically synthesized
ugagaaggcgguacagcuc

SEQ ID NO: 8316 - RNA, 19 nt, artificial
  Chemically synthesized
ucagggacaggucuaaaga

SEQ ID NO: 8317 - RNA, 19 nt, artificial
  Chemically synthesized
cgauggacuucuaaaccag

SEQ ID NO: 8318 - RNA, 19 nt, artificial
  Chemically synthesized
augcuggaaauccagaugu

SEQ ID NO: 8319 - RNA, 19 nt, artificial
  Chemically synthesized
cuagaaacucaaggcuugg

SEQ ID NO: 8320 - RNA, 19 nt, Artificial Sequence
  Chemically synthesized
gagacuacuguacaagcac

SEQ ID NO: 8321 - RNA, 19 nt, artificial
  Chemically synthesized
uucucagcaggaacacuua

SEQ ID NO: 8322 - RNA, 19 nt, artificial
  Chemically synthesized
ccauugcugccaacaucau

SEQ ID NO: 8323 - RNA, 19 nt, artificial
  Chemically synthesized
guucuauuuucaccugaug

SEQ ID NO: 8324 - RNA, 19 nt, artificial
  Chemically synthesized
ugguucugggagaauuuag

SEQ ID NO: 8325 - RNA, 19 nt, artificial
  Chemically synthesized
cauccagagccgcuggugu

SEQ ID NO: 8326 - RNA, 19 nt, artificial
  Chemically synthesized
ccauuggacaucucaaaac

SEQ ID NO: 8327 - RNA, 19 nt, artificial
  Chemically synthesized
aaacuucuugggcuuagaa

SEQ ID NO: 8328 - RNA, 19 nt, artificial
  Chemically synthesized
augaugccuuuguuaucua

SEQ ID NO: 8329 - RNA, 19 nt, artificial
  Chemically synthesized
agcacuucauccagagccg

SEQ ID NO: 8330 - RNA, 19 nt, artificial
  Chemically synthesized
cucaaucucucuuuagacc

SEQ ID NO: 8331 - RNA, 19 nt, artificial
  Chemically synthesized
uauuuagaucugagcuuca

SEQ ID NO: 8332 - RNA, 19 nt, artificial
  Chemically synthesized
cuauuuucaccugaugcuu

SEQ ID NO: 8333 - RNA, 19 nt, artificial
  Chemically synthesized
auugcucagaccuggcagu

SEQ ID NO: 8334 - RNA, 19 nt, artificial
  Chemically synthesized
cgccuggcugggacucuga

SEQ ID NO: 8335 - RNA, 19 nt, artificial
  Chemically synthesized
acucaagccaggaugagga

SEQ ID NO: 8336 - RNA, 19 nt, artificial
  Chemically synthesized
auugaagaauuccgauuag

SEQ ID NO: 8337 - RNA, 19 nt, artificial
  Chemically synthesized
cuacagagacuuuauuccc

SEQ ID NO: 8338 - RNA, 19 nt, artificial
  Chemically synthesized
uugaguuucuagaucucag

SEQ ID NO: 8339 - RNA, 19 nt, artificial
  Chemically synthesized
cacuucauccagagccgcu

SEQ ID NO: 8340 - RNA, 19 nt, artificial
  Chemically synthesized
agagccgcugguguaucuu

SEQ ID NO: 8341 - RNA, 19 nt, artificial
  Chemically synthesized
agcucugccuucacuacag

SEQ ID NO: 8342 - RNA, 19 nt, artificial
  Chemically synthesized
cuuaauguggcucacaauc

SEQ ID NO: 8343 - RNA, 19 nt, artificial
  Chemically synthesized
acuacagagacuuuauucc

SEQ ID NO: 8344 - RNA, 19 nt, artificial
  Chemically synthesized
aaauggcuggcaauucuuu

SEQ ID NO: 8345 - RNA, 19 nt, artificial
  Chemically synthesized
uuaccaugaguucaaacuu

SEQ ID NO: 8346 - RNA, 19 nt, artificial
  Chemically synthesized
uccagagccgcugguguau

SEQ ID NO: 8347 - RNA, 19 nt, artificial
  Chemically synthesized
cagcucugccuucacuaca

SEQ ID NO: 8348 - RNA, 19 nt, artificial
  Chemically synthesized
ccuucucagcaggaacacu

SEQ ID NO: 8349 - RNA, 19 nt, artificial
  Chemically synthesized
uaccaugaguucaaacuuc

SEQ ID NO: 8350 - RNA, 19 nt, artificial
  Chemically synthesized
ucuaugaugccuuuguuau

SEQ ID NO: 8351 - RNA, 19 nt, artificial
  Chemically synthesized
gaugccuuuguuaucuacu

SEQ ID NO: 8352 - RNA, 19 nt, artificial
  Chemically synthesized
cuucauuguccugcagaag

SEQ ID NO: 8353 - RNA, 19 nt, artificial
  Chemically synthesized
caugaguucaaacuucuug

SEQ ID NO: 8354 - RNA, 19 nt, artificial
  Chemically synthesized
uuguccugcagaaggugga

SEQ ID NO: 8355 - RNA, 19 nt, artificial
  Chemically synthesized
uugaauaugagauugcuca

SEQ ID NO: 8356 - RNA, 19 nt, artificial
  Chemically synthesized
ccgccuucucagcaggaac

SEQ ID NO: 8357 - RNA, 19 nt, artificial
  Chemically synthesized
aaguucuauuuucaccuga

SEQ ID NO: 8358 - RNA, 19 nt, artificial
  Chemically synthesized
ugcaauuugaccauugaag

SEQ ID NO: 8359 - RNA, 19 nt, artificial
  Chemically synthesized
cauuguccugcagaaggug

SEQ ID NO: 8360 - RNA, 19 nt, artificial
  Chemically synthesized
aucucucuuuagaccuguc

SEQ ID NO: 8361 - RNA, 19 nt, artificial
  Chemically synthesized
uuguuaucuacucaagcca

SEQ ID NO: 8362 - RNA, 19 nt, artificial
  Chemically synthesized
caucuucauuguccugcag

SEQ ID NO: 8363 - RNA, 19 nt, artificial
  Chemically synthesized
uaucuacucaagccaggau

SEQ ID NO: 8364 - RNA, 19 nt, artificial
  Chemically synthesized
auuaccaugaguucaaacu

SEQ ID NO: 8365 - RNA, 19 nt, artificial
  Chemically synthesized
cccagcacuucauccagag

SEQ ID NO: 8366 - RNA, 19 nt, artificial
  Chemically synthesized
aucuucauuguccugcaga

SEQ ID NO: 8367 - RNA, 19 nt, artificial
  Chemically synthesized
uguuaucuacucaagccag

SEQ ID NO: 8368 - RNA, 19 nt, artificial
  Chemically synthesized
ucccagcacuucauccaga

SEQ ID NO: 8369 - RNA, 19 nt, artificial
  Chemically synthesized
ucaaucucucuuuagaccu

SEQ ID NO: 8370 - RNA, 19 nt, artificial
  Chemically synthesized
agauugcucagaccuggca

SEQ ID NO: 8371 - RNA, 19 nt, artificial
  Chemically synthesized
ugucccagcacuucaucca

SEQ ID NO: 8372 - RNA, 19 nt, artificial
  Chemically synthesized
uuaucuacucaagccagga

SEQ ID NO: 8373 - RNA, 19 nt, artificial
  Chemically synthesized
cuaugaugccuuuguuauc

SEQ ID NO: 8374 - RNA, 19 nt, artificial
  Chemically synthesized
gccaggaugaggacugggu

SEQ ID NO: 8375 - RNA, 19 nt, artificial
  Chemically synthesized
aaaauggcuggcaauucuu

SEQ ID NO: 8376 - RNA, 19 nt, artificial
  Chemically synthesized
guuaucuacucaagccagg

SEQ ID NO: 8377 - RNA, 19 nt, artificial
  Chemically synthesized
cuuuguuaucuacucaagc

SEQ ID NO: 8378 - RNA, 19 nt, artificial
  Chemically synthesized
ccagagccgcugguguauc

SEQ ID NO: 8379 - RNA, 19 nt, artificial
  Chemically synthesized
auaugagauugcucagacc

SEQ ID NO: 8380 - RNA, 19 nt, artificial
  Chemically synthesized
ugagauugcucagaccugg

SEQ ID NO: 8381 - RNA, 19 nt, artificial
  Chemically synthesized
aaucucucuuuagaccugu

SEQ ID NO: 8382 - RNA, 19 nt, artificial
  Chemically synthesized
augccuuuguuaucuacuc

SEQ ID NO: 8383 - RNA, 19 nt, artificial
  Chemically synthesized
ucuauuuucaccugaugcu

SEQ ID NO: 8384 - RNA, 19 nt, artificial
  Chemically synthesized
uuuagaucugagcuucaau

SEQ ID NO: 8385 - RNA, 19 nt, artificial
  Chemically synthesized
aucuacucaagccaggaug

SEQ ID NO: 8386 - RNA, 19 nt, artificial
  Chemically synthesized
uuaauguggcucacaaucu

SEQ ID NO: 8387 - RNA, 19 nt, artificial
  Chemically synthesized
gcgccuggcugggacucug

SEQ ID NO: 8388 - RNA, 19 nt, artificial
  Chemically synthesized
uucaaacuucuugggcuua

SEQ ID NO: 8389 - RNA, 19 nt, artificial
  Chemically synthesized
augagauugcucagaccug

SEQ ID NO: 8390 - RNA, 19 nt, artificial
  Chemically synthesized
auuuucaccugaugcuucu

SEQ ID NO: 8391 - RNA, 19 nt, artificial
  Chemically synthesized
ucugccuucacuacagaga

SEQ ID NO: 8392 - RNA, 19 nt, artificial
  Chemically synthesized
augaguucaaacuucuugg

SEQ ID NO: 8393 - RNA, 19 nt, artificial
  Chemically synthesized
ugaauaugagauugcucag

SEQ ID NO: 8394 - RNA, 19 nt, artificial
  Chemically synthesized
caagccaggaugaggacug

SEQ ID NO: 8395 - RNA, 19 nt, artificial
  Chemically synthesized
gugauuuugggacaaccag

SEQ ID NO: 8396 - RNA, 19 nt, artificial
  Chemically synthesized
ugaugccuuuguuaucuac

SEQ ID NO: 8397 - RNA, 19 nt, artificial
  Chemically synthesized
uaugagauugcucagaccu

SEQ ID NO: 8398 - RNA, 19 nt, artificial
  Chemically synthesized
gauuguuguggugucccag

SEQ ID NO: 8399 - RNA, 19 nt, artificial
  Chemically synthesized
gagauugcucagaccuggc

SEQ ID NO: 8400 - RNA, 19 nt, artificial
  Chemically synthesized
cuucauccagagccgcugg

SEQ ID NO: 8401 - RNA, 19 nt, artificial
  Chemically synthesized
ggugucccagcacuucauc

SEQ ID NO: 8402 - RNA, 19 nt, artificial
  Chemically synthesized
gucccagcacuucauccag

SEQ ID NO: 8403 - RNA, 19 nt, artificial
  Chemically synthesized
ccuggcugggacucugauc

SEQ ID NO: 8404 - RNA, 19 nt, artificial
  Chemically synthesized
cauugcugccaacaucauc

SEQ ID NO: 8405 - RNA, 19 nt, artificial
  Chemically synthesized
aacuucuugggcuuagaac

SEQ ID NO: 8406 - RNA, 19 nt, artificial
  Chemically synthesized
cgcgccuggcugggacucu

SEQ ID NO: 8407 - RNA, 19 nt, artificial
  Chemically synthesized
gauugcucagaccuggcag

SEQ ID NO: 8408 - RNA, 19 nt, artificial
  Chemically synthesized
acuucauccagagccgcug

SEQ ID NO: 8409 - RNA, 19 nt, artificial
  Chemically synthesized
ugauuuugggacaaccagc

SEQ ID NO: 8410 - RNA, 19 nt, artificial
  Chemically synthesized
uucagcucugccuucacua

SEQ ID NO: 8411 - RNA, 19 nt, artificial
  Chemically synthesized
uguccugcagaagguggag

SEQ ID NO: 8412 - RNA, 19 nt, artificial
  Chemically synthesized
uugcucagaccuggcaguu

SEQ ID NO: 8413 - RNA, 19 nt, artificial
  Chemically synthesized
aauaugagauugcucagac

SEQ ID NO: 8414 - RNA, 19 nt, artificial
  Chemically synthesized
caggaacacuuaccuggag

SEQ ID NO: 8415 - RNA, 19 nt, artificial
  Chemically synthesized
gcacuucauccagagccgc

SEQ ID NO: 8416 - RNA, 19 nt, artificial
  Chemically synthesized
ugcugccaacaucauccau

SEQ ID NO: 8417 - RNA, 19 nt, artificial
  Chemically synthesized
cucaagccaggaugaggac

SEQ ID NO: 8418 - RNA, 19 nt, artificial
  Chemically synthesized
aaagaauuuagaagaaggg

SEQ ID NO: 8419 - RNA, 19 nt, artificial
  Chemically synthesized
ucuuugaauaugagauugc

SEQ ID NO: 8420 - RNA, 19 nt, artificial
  Chemically synthesized
ugaguucaaacuucuuggg

SEQ ID NO: 8421 - RNA, 19 nt, artificial
  Chemically synthesized
cagcaggaacacuuaccug

SEQ ID NO: 8422 - RNA, 19 nt, artificial
  Chemically synthesized
uauuaccaugaguucaaac

SEQ ID NO: 8423 - RNA, 19 nt, artificial
  Chemically synthesized
uuuguuaucuacucaagcc

SEQ ID NO: 8424 - RNA, 19 nt, artificial
  Chemically synthesized
uaaguucuauuuucaccug

SEQ ID NO: 8425 - RNA, 19 nt, artificial
  Chemically synthesized
gccuucucagcaggaacac

SEQ ID NO: 8426 - RNA, 19 nt, artificial
  Chemically synthesized
agcaggaacacuuaccugg

SEQ ID NO: 8427 - RNA, 19 nt, artificial
  Chemically synthesized
cucagcaggaacacuuacc

SEQ ID NO: 8428 - RNA, 19 nt, artificial
  Chemically synthesized
cuacucaagccaggaugag

SEQ ID NO: 8429 - RNA, 19 nt, artificial
  Chemically synthesized
aauggcuggcaauucuuuc

SEQ ID NO: 8430 - RNA, 19 nt, artificial
  Chemically synthesized
ccagcacuucauccagagc

SEQ ID NO: 8431 - RNA, 19 nt, artificial
  Chemically synthesized
uucauuguccugcagaagg

SEQ ID NO: 8432 - RNA, 19 nt, artificial
  Chemically synthesized
cucugccuucacuacagag

SEQ ID NO: 8433 - RNA, 19 nt, artificial
  Chemically synthesized
ucagcaggaacacuuaccu

SEQ ID NO: 8434 - RNA, 19 nt, artificial
  Chemically synthesized
uaugaugccuuuguuaucu

SEQ ID NO: 8435 - RNA, 19 nt, artificial
  Chemically synthesized
ucaaacuucuugggcuuag

SEQ ID NO: 8436 - RNA, 19 nt, artificial
  Chemically synthesized
aacuuuauccaaccaggug

SEQ ID NO: 8437 - RNA, 19 nt, artificial
  Chemically synthesized
auggcuggcaauucuuucc

SEQ ID NO: 8438 - RNA, 19 nt, artificial
  Chemically synthesized
auuguccugcagaaggugg

SEQ ID NO: 8439 - RNA, 19 nt, artificial
  Chemically synthesized
cagcacuucauccagagcc

SEQ ID NO: 8440 - RNA, 19 nt, artificial
  Chemically synthesized
uaucaucuucauuguccug

SEQ ID NO: 8441 - RNA, 19 nt, artificial
  Chemically synthesized
uacagcauuuuccaaguag

SEQ ID NO: 8442 - RNA, 19 nt, artificial
  Chemically synthesized
gugucccagcacuucaucc

SEQ ID NO: 8443 - RNA, 19 nt, artificial
  Chemically synthesized
uacucaagccaggaugagg

SEQ ID NO: 8444 - RNA, 19 nt, artificial
  Chemically synthesized
cuggcugggacucugaucc

SEQ ID NO: 8445 - RNA, 19 nt, artificial
  Chemically synthesized
ucagcucugccuucacuac

SEQ ID NO: 8446 - RNA, 19 nt, artificial
  Chemically synthesized
uuuucaccugaugcuucuu

SEQ ID NO: 8447 - RNA, 19 nt, artificial
  Chemically synthesized
gaguucaaacuucuugggc

SEQ ID NO: 8448 - RNA, 19 nt, artificial
  Chemically synthesized
uugcugccaacaucaucca

SEQ ID NO: 8449 - RNA, 19 nt, artificial
  Chemically synthesized
uauuuucaccugaugcuuc

SEQ ID NO: 8450 - RNA, 19 nt, artificial
  Chemically synthesized
uuucagcucugccuucacu

SEQ ID NO: 8451 - RNA, 19 nt, artificial
  Chemically synthesized
uuagaucugagcuucaaug

SEQ ID NO: 8452 - RNA, 19 nt, artificial
  Chemically synthesized
ucaagccaggaugaggacu

SEQ ID NO: 8453 - RNA, 19 nt, artificial
  Chemically synthesized
uuugaauaugagauugcuc

SEQ ID NO: 8454 - RNA, 19 nt, artificial
  Chemically synthesized
ucucagcaggaacacuuac

SEQ ID NO: 8455 - RNA, 19 nt, artificial
  Chemically synthesized
aagccaggaugaggacugg

SEQ ID NO: 8456 - RNA, 19 nt, artificial
  Chemically synthesized
auuucagcucugccuucac

SEQ ID NO: 8457 - RNA, 19 nt, artificial
  Chemically synthesized
ucccagccauggccuuccu

SEQ ID NO: 8458 - RNA, 19 nt, artificial
  Chemically synthesized
uucuauuuucaccugaugc

SEQ ID NO: 8459 - RNA, 19 nt, artificial
  Chemically synthesized
ucauccagagccgcuggug

SEQ ID NO: 8460 - RNA, 19 nt, artificial
  Chemically synthesized
auugcugccaacaucaucc

SEQ ID NO: 8461 - RNA, 19 nt, artificial
  Chemically synthesized
agccaggaugaggacuggg

SEQ ID NO: 8462 - RNA, 19 nt, artificial
  Chemically synthesized
uucauccagagccgcuggu

SEQ ID NO: 8463 - RNA, 19 nt, artificial
  Chemically synthesized
ucucucuuuagaccugucc

SEQ ID NO: 8464 - RNA, 19 nt, artificial
  Chemically synthesized
uagaucugagcuucaaugg

SEQ ID NO: 8465 - RNA, 19 nt, artificial
  Chemically synthesized
cccagccauggccuuccuc

SEQ ID NO: 8466 - RNA, 19 nt, artificial
  Chemically synthesized
aucccagccauggccuucc

SEQ ID NO: 8467 - RNA, 19 nt, artificial
  Chemically synthesized
uaaguguuccugcugagaa

SEQ ID NO: 8468 - RNA, 19 nt, artificial
  Chemically synthesized
augauguuggcagcaaugg

SEQ ID NO: 8469 - RNA, 19 nt, artificial
  Chemically synthesized
caucaggugaaaauagaac

SEQ ID NO: 8470 - RNA, 19 nt, artificial
  Chemically synthesized
cuaaauucucccagaacca

SEQ ID NO: 8471 - RNA, 19 nt, artificial
  Chemically synthesized
acaccagcggcucuggaug

SEQ ID NO: 8472 - RNA, 19 nt, artificial
  Chemically synthesized
guuuugagauguccaaugg

SEQ ID NO: 8473 - RNA, 19 nt, artificial
  Chemically synthesized
uucuaagcccaagaaguuu

SEQ ID NO: 8474 - RNA, 19 nt, artificial
  Chemically synthesized
uagauaacaaaggcaucau

SEQ ID NO: 8475 - RNA, 19 nt, artificial
  Chemically synthesized
cggcucuggaugaagugcu

SEQ ID NO: 8476 - RNA, 19 nt, artificial
  Chemically synthesized
ggucuaaagagagauugag

SEQ ID NO: 8477 - RNA, 19 nt, artificial
  Chemically synthesized
ugaagcucagaucuaaaua

SEQ ID NO: 8478 - RNA, 19 nt, artificial
  Chemically synthesized
aagcaucaggugaaaauag

SEQ ID NO: 8479 - RNA, 19 nt, artificial
  Chemically synthesized
acugccaggucugagcaau

SEQ ID NO: 8480 - RNA, 19 nt, artificial
  Chemically synthesized
ucagagucccagccaggcg

SEQ ID NO: 8481 - RNA, 19 nt, artificial
  Chemically synthesized
uccucauccuggcuugagu

SEQ ID NO: 8482 - RNA, 19 nt, artificial
  Chemically synthesized
cuaaucggaauucuucaau

SEQ ID NO: 8483 - RNA, 19 nt, artificial
  Chemically synthesized
gggaauaaagucucuguag

SEQ ID NO: 8484 - RNA, 19 nt, artificial
  Chemically synthesized
cugagaucuagaaacucaa

SEQ ID NO: 8485 - RNA, 19 nt, artificial
  Chemically synthesized
agcggcucuggaugaagug

SEQ ID NO: 8486 - RNA, 19 nt, artificial
  Chemically synthesized
aagauacaccagcggcucu

SEQ ID NO: 8487 - RNA, 19 nt, artificial
  Chemically synthesized
cuguagugaaggcagagcu

SEQ ID NO: 8488 - RNA, 19 nt, artificial
  Chemically synthesized
gauugugagccacauuaag

SEQ ID NO: 8489 - RNA, 19 nt, artificial
  Chemically synthesized
ggaauaaagucucuguagu

SEQ ID NO: 8490 - RNA, 19 nt, artificial
  Chemically synthesized
aaagaauugccagccauuu

SEQ ID NO: 8491 - RNA, 19 nt, artificial
  Chemically synthesized
aaguuugaacucaugguaa

SEQ ID NO: 8492 - RNA, 19 nt, artificial
  Chemically synthesized
auacaccagcggcucugga

SEQ ID NO: 8493 - RNA, 19 nt, artificial
  Chemically synthesized
uguagugaaggcagagcug

SEQ ID NO: 8494 - RNA, 19 nt, artificial
  Chemically synthesized
aguguuccugcugagaagg

SEQ ID NO: 8495 - RNA, 19 nt, artificial
  Chemically synthesized
gaaguuugaacucauggua

SEQ ID NO: 8496 - RNA, 19 nt, artificial
  Chemically synthesized
auaacaaaggcaucauaga

SEQ ID NO: 8497 - RNA, 19 nt, artificial
  Chemically synthesized
aguagauaacaaaggcauc

SEQ ID NO: 8498 - RNA, 19 nt, artificial
  Chemically synthesized
cuucugcaggacaaugaag

SEQ ID NO: 8499 - RNA, 19 nt, artificial
  Chemically synthesized
caagaaguuugaacucaug

SEQ ID NO: 8500 - RNA, 19 nt, artificial
  Chemically synthesized
uccaccuucugcaggacaa

SEQ ID NO: 8501 - RNA, 19 nt, artificial
  Chemically synthesized
ugagcaaucucauauucaa

SEQ ID NO: 8502 - RNA, 19 nt, artificial
  Chemically synthesized
guuccugcugagaaggcgg

SEQ ID NO: 8503 - RNA, 19 nt, artificial
  Chemically synthesized
ucaggugaaaauagaacuu

SEQ ID NO: 8504 - RNA, 19 nt, artificial
  Chemically synthesized
cuucaauggucaaauugca

SEQ ID NO: 8505 - RNA, 19 nt, artificial
  Chemically synthesized
caccuucugcaggacaaug

SEQ ID NO: 8506 - RNA, 19 nt, artificial
  Chemically synthesized
gacaggucuaaagagagau

SEQ ID NO: 8507 - RNA, 19 nt, artificial
  Chemically synthesized
uggcuugaguagauaacaa

SEQ ID NO: 8508 - RNA, 19 nt, artificial
  Chemically synthesized
cugcaggacaaugaagaug

SEQ ID NO: 8509 - RNA, 19 nt, artificial
  Chemically synthesized
auccuggcuugaguagaua

SEQ ID NO: 8510 - RNA, 19 nt, artificial
  Chemically synthesized
aguuugaacucaugguaau

SEQ ID NO: 8511 - RNA, 19 nt, artificial
  Chemically synthesized
cucuggaugaagugcuggg

SEQ ID NO: 8512 - RNA, 19 nt, artificial
  Chemically synthesized
ucugcaggacaaugaagau

SEQ ID NO: 8513 - RNA, 19 nt, artificial
  Chemically synthesized
cuggcuugaguagauaaca

SEQ ID NO: 8514 - RNA, 19 nt, artificial
  Chemically synthesized
ucuggaugaagugcuggga

SEQ ID NO: 8515 - RNA, 19 nt, artificial
  Chemically synthesized
aggucuaaagagagauuga

SEQ ID NO: 8516 - RNA, 19 nt, artificial
  Chemically synthesized
ugccaggucugagcaaucu

SEQ ID NO: 8517 - RNA, 19 nt, artificial
  Chemically synthesized
uggaugaagugcugggaca

SEQ ID NO: 8518 - RNA, 19 nt, artificial
  Chemically synthesized
uccuggcuugaguagauaa

SEQ ID NO: 8519 - RNA, 19 nt, artificial
  Chemically synthesized
gauaacaaaggcaucauag

SEQ ID NO: 8520 - RNA, 19 nt, artificial
  Chemically synthesized
acccaguccucauccuggc

SEQ ID NO: 8521 - RNA, 19 nt, artificial
  Chemically synthesized
aagaauugccagccauuuu

SEQ ID NO: 8522 - RNA, 19 nt, artificial
  Chemically synthesized
ccuggcuugaguagauaac

SEQ ID NO: 8523 - RNA, 19 nt, artificial
  Chemically synthesized
gcuugaguagauaacaaag

SEQ ID NO: 8524 - RNA, 19 nt, artificial
  Chemically synthesized
gauacaccagcggcucugg

SEQ ID NO: 8525 - RNA, 19 nt, artificial
  Chemically synthesized
ggucugagcaaucucauau

SEQ ID NO: 8526 - RNA, 19 nt, artificial
  Chemically synthesized
ccaggucugagcaaucuca

SEQ ID NO: 8527 - RNA, 19 nt, artificial
  Chemically synthesized
acaggucuaaagagagauu

SEQ ID NO: 8528 - RNA, 19 nt, artificial
  Chemically synthesized
gaguagauaacaaaggcau

SEQ ID NO: 8529 - RNA, 19 nt, artificial
  Chemically synthesized
agcaucaggugaaaauaga

SEQ ID NO: 8530 - RNA, 19 nt, artificial
  Chemically synthesized
auugaagcucagaucuaaa

SEQ ID NO: 8531 - RNA, 19 nt, artificial
  Chemically synthesized
cauccuggcuugaguagau

SEQ ID NO: 8532 - RNA, 19 nt, artificial
  Chemically synthesized
agauugugagccacauuaa

SEQ ID NO: 8533 - RNA, 19 nt, artificial
  Chemically synthesized
cagagucccagccaggcgc

SEQ ID NO: 8534 - RNA, 19 nt, artificial
  Chemically synthesized
uaagcccaagaaguuugaa

SEQ ID NO: 8535 - RNA, 19 nt, artificial
  Chemically synthesized
caggucugagcaaucucau

SEQ ID NO: 8536 - RNA, 19 nt, artificial
  Chemically synthesized
agaagcaucaggugaaaau

SEQ ID NO: 8537 - RNA, 19 nt, artificial
  Chemically synthesized
ucucuguagugaaggcaga

SEQ ID NO: 8538 - RNA, 19 nt, artificial
  Chemically synthesized
ccaagaaguuugaacucau

SEQ ID NO: 8539 - RNA, 19 nt, artificial
  Chemically synthesized
cugagcaaucucauauuca

SEQ ID NO: 8540 - RNA, 19 nt, artificial
  Chemically synthesized
caguccucauccuggcuug

SEQ ID NO: 8541 - RNA, 19 nt, artificial
  Chemically synthesized
cugguugucccaaaaucac

SEQ ID NO: 8542 - RNA, 19 nt, artificial
  Chemically synthesized
guagauaacaaaggcauca

SEQ ID NO: 8543 - RNA, 19 nt, artificial
  Chemically synthesized
aggucugagcaaucucaua

SEQ ID NO: 8544 - RNA, 19 nt, artificial
  Chemically synthesized
cugggacaccacaacaauc

SEQ ID NO: 8545 - RNA, 19 nt, artificial
  Chemically synthesized
gccaggucugagcaaucuc

SEQ ID NO: 8546 - RNA, 19 nt, artificial
  Chemically synthesized
ccagcggcucuggaugaag

SEQ ID NO: 8547 - RNA, 19 nt, artificial
  Chemically synthesized
gaugaagugcugggacacc

SEQ ID NO: 8548 - RNA, 19 nt, artificial
  Chemically synthesized
cuggaugaagugcugggac

SEQ ID NO: 8549 - RNA, 19 nt, artificial
  Chemically synthesized
gaucagagucccagccagg

SEQ ID NO: 8550 - RNA, 19 nt, artificial
  Chemically synthesized
gaugauguuggcagcaaug

SEQ ID NO: 8551 - RNA, 19 nt, artificial
  Chemically synthesized
guucuaagcccaagaaguu

SEQ ID NO: 8552 - RNA, 19 nt, artificial
  Chemically synthesized
agagucccagccaggcgcg

SEQ ID NO: 8553 - RNA, 19 nt, artificial
  Chemically synthesized
cugccaggucugagcaauc

SEQ ID NO: 8554 - RNA, 19 nt, artificial
  Chemically synthesized
cagcggcucuggaugaagu

SEQ ID NO: 8555 - RNA, 19 nt, artificial
  Chemically synthesized
gcugguugucccaaaauca

SEQ ID NO: 8556 - RNA, 19 nt, artificial
  Chemically synthesized
uagugaaggcagagcugaa

SEQ ID NO: 8557 - RNA, 19 nt, artificial
  Chemically synthesized
cuccaccuucugcaggaca

SEQ ID NO: 8558 - RNA, 19 nt, artificial
  Chemically synthesized
aacugccaggucugagcaa

SEQ ID NO: 8559 - RNA, 19 nt, artificial
  Chemically synthesized
gucugagcaaucucauauu

SEQ ID NO: 8560 - RNA, 19 nt, artificial
  Chemically synthesized
cuccagguaaguguuccug

SEQ ID NO: 8561 - RNA, 19 nt, artificial
  Chemically synthesized
gcggcucuggaugaagugc

SEQ ID NO: 8562 - RNA, 19 nt, artificial
  Chemically synthesized
auggaugauguuggcagca

SEQ ID NO: 8563 - RNA, 19 nt, artificial
  Chemically synthesized
guccucauccuggcuugag

SEQ ID NO: 8564 - RNA, 19 nt, artificial
  Chemically synthesized
cccuucuucuaaauucuuu

SEQ ID NO: 8565 - RNA, 19 nt, artificial
  Chemically synthesized
gcaaucucauauucaaaga

SEQ ID NO: 8566 - RNA, 19 nt, artificial
  Chemically synthesized
cccaagaaguuugaacuca

SEQ ID NO: 8567 - RNA, 19 nt, artificial
  Chemically synthesized
cagguaaguguuccugcug

SEQ ID NO: 8568 - RNA, 19 nt, artificial
  Chemically synthesized
guuugaacucaugguaaua

SEQ ID NO: 8569 - RNA, 19 nt, artificial
  Chemically synthesized
ggcuugaguagauaacaaa

SEQ ID NO: 8570 - RNA, 19 nt, artificial
  Chemically synthesized
caggugaaaauagaacuua

SEQ ID NO: 8571 - RNA, 19 nt, artificial
  Chemically synthesized
guguuccugcugagaaggc

SEQ ID NO: 8572 - RNA, 19 nt, artificial
  Chemically synthesized
ccagguaaguguuccugcu

SEQ ID NO: 8573 - RNA, 19 nt, artificial
  Chemically synthesized
gguaaguguuccugcugag

SEQ ID NO: 8574 - RNA, 19 nt, artificial
  Chemically synthesized
cucauccuggcuugaguag

SEQ ID NO: 8575 - RNA, 19 nt, artificial
  Chemically synthesized
gaaagaauugccagccauu

SEQ ID NO: 8576 - RNA, 19 nt, artificial
  Chemically synthesized
gcucuggaugaagugcugg

SEQ ID NO: 8577 - RNA, 19 nt, artificial
  Chemically synthesized
ccuucugcaggacaaugaa

SEQ ID NO: 8578 - RNA, 19 nt, artificial
  Chemically synthesized
cucuguagugaaggcagag

SEQ ID NO: 8579 - RNA, 19 nt, artificial
  Chemically synthesized
agguaaguguuccugcuga

SEQ ID NO: 8580 - RNA, 19 nt, artificial
  Chemically synthesized
agauaacaaaggcaucaua

SEQ ID NO: 8581 - RNA, 19 nt, artificial
  Chemically synthesized
cuaagcccaagaaguuuga

SEQ ID NO: 8582 - RNA, 19 nt, artificial
  Chemically synthesized
caccugguuggauaaaguu

SEQ ID NO: 8583 - RNA, 19 nt, artificial
  Chemically synthesized
ggaaagaauugccagccau

SEQ ID NO: 8584 - RNA, 19 nt, artificial
  Chemically synthesized
ccaccuucugcaggacaau

SEQ ID NO: 8585 - RNA, 19 nt, artificial
  Chemically synthesized
ggcucuggaugaagugcug

SEQ ID NO: 8586 - RNA, 19 nt, artificial
  Chemically synthesized
caggacaaugaagaugaua

SEQ ID NO: 8587 - RNA, 19 nt, artificial
  Chemically synthesized
cuacuuggaaaaugcugua

SEQ ID NO: 8588 - RNA, 19 nt, artificial
  Chemically synthesized
ggaugaagugcugggacac

SEQ ID NO: 8589 - RNA, 19 nt, artificial
  Chemically synthesized
ccucauccuggcuugagua

SEQ ID NO: 8590 - RNA, 19 nt, artificial
  Chemically synthesized
ggaucagagucccagccag

SEQ ID NO: 8591 - RNA, 19 nt, artificial
  Chemically synthesized
guagugaaggcagagcuga

SEQ ID NO: 8592 - RNA, 19 nt, artificial
  Chemically synthesized
aagaagcaucaggugaaaa

SEQ ID NO: 8593 - RNA, 19 nt, artificial
  Chemically synthesized
gcccaagaaguuugaacuc

SEQ ID NO: 8594 - RNA, 19 nt, artificial
  Chemically synthesized
uggaugauguuggcagcaa

SEQ ID NO: 8595 - RNA, 19 nt, artificial
  Chemically synthesized
gaagcaucaggugaaaaua

SEQ ID NO: 8596 - RNA, 19 nt, artificial
  Chemically synthesized
agugaaggcagagcugaaa

SEQ ID NO: 8597 - RNA, 19 nt, artificial
  Chemically synthesized
cauugaagcucagaucuaa

SEQ ID NO: 8598 - RNA, 19 nt, artificial
  Chemically synthesized
aguccucauccuggcuuga

SEQ ID NO: 8599 - RNA, 19 nt, artificial
  Chemically synthesized
gagcaaucucauauucaaa

SEQ ID NO: 8600 - RNA, 19 nt, artificial
  Chemically synthesized
guaaguguuccugcugaga

SEQ ID NO: 8601 - RNA, 19 nt, artificial
  Chemically synthesized
ccaguccucauccuggcuu

SEQ ID NO: 8602 - RNA, 19 nt, artificial
  Chemically synthesized
gugaaggcagagcugaaau

SEQ ID NO: 8603 - RNA, 19 nt, artificial
  Chemically synthesized
aggaaggccauggcuggga

SEQ ID NO: 8604 - RNA, 19 nt, artificial
  Chemically synthesized
gcaucaggugaaaauagaa

SEQ ID NO: 8605 - RNA, 19 nt, artificial
  Chemically synthesized
caccagcggcucuggauga

SEQ ID NO: 8606 - RNA, 19 nt, artificial
  Chemically synthesized
ggaugauguuggcagcaau

SEQ ID NO: 8607 - RNA, 19 nt, artificial
  Chemically synthesized
cccaguccucauccuggcu

SEQ ID NO: 8608 - RNA, 19 nt, artificial
  Chemically synthesized
accagcggcucuggaugaa

SEQ ID NO: 8609 - RNA, 19 nt, artificial
  Chemically synthesized
ggacaggucuaaagagaga

SEQ ID NO: 8610 - RNA, 19 nt, artificial
  Chemically synthesized
ccauugaagcucagaucua

SEQ ID NO: 8611 - RNA, 19 nt, artificial
  Chemically synthesized
gaggaaggccauggcuggg

SEQ ID NO: 8612 - RNA, 19 nt, Artificial Sequence
  Chemically synthesized
ggaaggccauggcugggau

SEQ ID NO: 8613 - RNA, 18 nt, artificial
  Chemically synthesized
gguucuugauuacagucu

SEQ ID NO: 8614 - RNA, 18 nt, artificial
  Chemically synthesized
ggaguugucuaauuggua

SEQ ID NO: 8615 - RNA, 18 nt, artificial
  Chemically synthesized
ggguguguuuccaugucu

SEQ ID NO: 8616 - RNA, 18 nt, artificial
  Chemically synthesized
ggcuugaguuucaaaggu

SEQ ID NO: 8617 - RNA, 18 nt, artificial
  Chemically synthesized
gucuauggcuguuugaga

SEQ ID NO: 8618 - RNA, 18 nt, artificial
  Chemically synthesized
ggcuguguguauuugaaa

SEQ ID NO: 8619 - RNA, 18 nt, artificial
  Chemically synthesized
ggcuaauuccuaaggaaa

SEQ ID NO: 8620 - RNA, 18 nt, artificial
  Chemically synthesized
gguggaaguugaacgaau

SEQ ID NO: 8621 - RNA, 18 nt, artificial
  Chemically synthesized
gcaacaagauucaaagua

SEQ ID NO: 8622 - RNA, 18 nt, artificial
  Chemically synthesized
gucuuaucauggacaauu

SEQ ID NO: 8623 - RNA, 18 nt, artificial
  Chemically synthesized
gcggguucuacaucaaau

SEQ ID NO: 8624 - RNA, 18 nt, artificial
  Chemically synthesized
ggaagagaagacaccagu

SEQ ID NO: 8625 - RNA, 18 nt, artificial
  Chemically synthesized
gcuugaguuucaaagguu

SEQ ID NO: 8626 - RNA, 18 nt, artificial
  Chemically synthesized
ggagacaaaucuagcauc

SEQ ID NO: 8627 - RNA, 18 nt, artificial
  Chemically synthesized
ggcuguuugagaugaguu

SEQ ID NO: 8628 - RNA, 18 nt, artificial
  Chemically synthesized
gaguauacauugcuguuu

SEQ ID NO: 8629 - RNA, 18 nt, artificial
  Chemically synthesized
ggugugaaauccagacaa

SEQ ID NO: 8630 - RNA, 18 nt, artificial
  Chemically synthesized
ggaggaagggagaaauga

SEQ ID NO: 8631 - RNA, 18 nt, artificial
  Chemically synthesized
ggaugucuauggcuguuu

SEQ ID NO: 8632 - RNA, 18 nt, artificial
  Chemically synthesized
gcucagaccuggcaguuu

SEQ ID NO: 8633 - RNA, 18 nt, artificial
  Chemically synthesized
ggugggcauuucaaccaa

SEQ ID NO: 8634 - RNA, 18 nt, artificial
  Chemically synthesized
gagugaguuuucaguauu

SEQ ID NO: 8635 - RNA, 18 nt, artificial
  Chemically synthesized
gaugaguucucuacucuu

SEQ ID NO: 8636 - RNA, 18 nt, artificial
  Chemically synthesized
ggugaaaacaucuaugau

SEQ ID NO: 8637 - RNA, 18 nt, artificial
  Chemically synthesized
gccuugaguuucuagauc

SEQ ID NO: 8638 - RNA, 18 nt, artificial
  Chemically synthesized
ggcauuucaaccaacuca

SEQ ID NO: 8639 - RNA, 18 nt, artificial
  Chemically synthesized
gcuguggagacaaaucua

SEQ ID NO: 8640 - RNA, 18 nt, artificial
  Chemically synthesized
gcaacaucuaucugaaga

SEQ ID NO: 8641 - RNA, 18 nt, artificial
  Chemically synthesized
caguauuccuaucacuca

SEQ ID NO: 8642 - RNA, 18 nt, artificial
  Chemically synthesized
agaguuuccugcaaugga

SEQ ID NO: 8643 - RNA, 18 nt, artificial
  Chemically synthesized
ugacaaaucugcucuaga

SEQ ID NO: 8644 - RNA, 18 nt, artificial
  Chemically synthesized
ccuugaguuucuagaucu

SEQ ID NO: 8645 - RNA, 18 nt, artificial
  Chemically synthesized
ggcguuuucuucuucuaa

SEQ ID NO: 8646 - RNA, 18 nt, artificial
  Chemically synthesized
gccuaagccaccucucua

SEQ ID NO: 8647 - RNA, 18 nt, artificial
  Chemically synthesized
gccuuaugcuaaggguga

SEQ ID NO: 8648 - RNA, 18 nt, artificial
  Chemically synthesized
ugcagaagguggagaaga

SEQ ID NO: 8649 - RNA, 18 nt, artificial
  Chemically synthesized
ccuucacuacagagacuu

SEQ ID NO: 8650 - RNA, 18 nt, artificial
  Chemically synthesized
ccuuuguuaucuacucaa

SEQ ID NO: 8651 - RNA, 18 nt, artificial
  Chemically synthesized
gggagaaaugaggaaaua

SEQ ID NO: 8652 - RNA, 18 nt, artificial
  Chemically synthesized
guggcuguggagacaaau

SEQ ID NO: 8653 - RNA, 18 nt, artificial
  Chemically synthesized
cagucucaaucacauaau

SEQ ID NO: 8654 - RNA, 18 nt, artificial
  Chemically synthesized
gguggcuguggagacaaa

SEQ ID NO: 8655 - RNA, 18 nt, artificial
  Chemically synthesized
ggaagaaaauuuccgcuu

SEQ ID NO: 8656 - RNA, 18 nt, artificial
  Chemically synthesized
gggaguauacauugcugu

SEQ ID NO: 8657 - RNA, 18 nt, artificial
  Chemically synthesized
gaagagagugugauuaua

SEQ ID NO: 8658 - RNA, 18 nt, artificial
  Chemically synthesized
cacuacagagacuuuauu

SEQ ID NO: 8659 - RNA, 18 nt, artificial
  Chemically synthesized
cgagcauguucuauuuuu

SEQ ID NO: 8660 - RNA, 18 nt, artificial
  Chemically synthesized
gcaucucuagagaacuuc

SEQ ID NO: 8661 - RNA, 18 nt, artificial
  Chemically synthesized
cucacaaucuuauccaau

SEQ ID NO: 8662 - RNA, 18 nt, artificial
  Chemically synthesized
ggagaaaugaggaaauag

SEQ ID NO: 8663 - RNA, 18 nt, artificial
  Chemically synthesized
agacuugcggguucuaca

SEQ ID NO: 8664 - RNA, 18 nt, artificial
  Chemically synthesized
cuguuugagaugaguucu

SEQ ID NO: 8665 - RNA, 18 nt, artificial
  Chemically synthesized
gcaggaagcaacaucuau

SEQ ID NO: 8666 - RNA, 18 nt, artificial
  Chemically synthesized
gcguuuucuucuucuaac

SEQ ID NO: 8667 - RNA, 18 nt, artificial
  Chemically synthesized
ucuagaucucaguagaaa

SEQ ID NO: 8668 - RNA, 18 nt, artificial
  Chemically synthesized
ggcuccugaugcaagaug

SEQ ID NO: 8669 - RNA, 18 nt, artificial
  Chemically synthesized
ggaccuuuccagcaacaa

SEQ ID NO: 8670 - RNA, 18 nt, artificial
  Chemically synthesized
ccugcgugagaccagaaa

SEQ ID NO: 8671 - RNA, 18 nt, artificial
  Chemically synthesized
caccagaguugcuuucaa

SEQ ID NO: 8672 - RNA, 18 nt, artificial
  Chemically synthesized
ugcggguucuacaucaaa

SEQ ID NO: 8673 - RNA, 18 nt, artificial
  Chemically synthesized
gauguuugauggaccucu

SEQ ID NO: 8674 - RNA, 18 nt, artificial
  Chemically synthesized
gaguuuucaguauuccua

SEQ ID NO: 8675 - RNA, 18 nt, artificial
  Chemically synthesized
gcuuccuggucuuaucau

SEQ ID NO: 8676 - RNA, 18 nt, artificial
  Chemically synthesized
ggugaguaauuccauggu

SEQ ID NO: 8677 - RNA, 18 nt, artificial
  Chemically synthesized
ugaccaaucuagagcacu

SEQ ID NO: 8678 - RNA, 18 nt, artificial
  Chemically synthesized
gagucuuccaggugggca

SEQ ID NO: 8679 - RNA, 18 nt, artificial
  Chemically synthesized
ggucuuaucauggacaau

SEQ ID NO: 8680 - RNA, 18 nt, artificial
  Chemically synthesized
caucauccaugaagguuu

SEQ ID NO: 8681 - RNA, 18 nt, artificial
  Chemically synthesized
agacaaaucuagcaucuc

SEQ ID NO: 8682 - RNA, 18 nt, artificial
  Chemically synthesized
cuucuaacuuccucuccu

SEQ ID NO: 8683 - RNA, 18 nt, artificial
  Chemically synthesized
cucucaaaaggcuuacuu

SEQ ID NO: 8684 - RNA, 18 nt, artificial
  Chemically synthesized
ccuccagguucuugauua

SEQ ID NO: 8685 - RNA, 18 nt, artificial
  Chemically synthesized
ggcaggaagcaacaucua

SEQ ID NO: 8686 - RNA, 18 nt, artificial
  Chemically synthesized
ggcaacauuuagaauuag

SEQ ID NO: 8687 - RNA, 18 nt, artificial
  Chemically synthesized
gguugcuguucucaaagu

SEQ ID NO: 8688 - RNA, 18 nt, artificial
  Chemically synthesized
uggagacaaaucuagcau

SEQ ID NO: 8689 - RNA, 18 nt, artificial
  Chemically synthesized
guuugguucugggagaau

SEQ ID NO: 8690 - RNA, 18 nt, artificial
  Chemically synthesized
gucucgaagucuugaaaa

SEQ ID NO: 8691 - RNA, 18 nt, artificial
  Chemically synthesized
augcuaagggugaguaau

SEQ ID NO: 8692 - RNA, 18 nt, artificial
  Chemically synthesized
agaacugcuuugaauaca

SEQ ID NO: 8693 - RNA, 18 nt, artificial
  Chemically synthesized
gcaguucuggucuauaag

SEQ ID NO: 8694 - RNA, 18 nt, artificial
  Chemically synthesized
ccucgaugauauuauuga

SEQ ID NO: 8695 - RNA, 18 nt, artificial
  Chemically synthesized
cugggagaauuuagaaau

SEQ ID NO: 8696 - RNA, 18 nt, artificial
  Chemically synthesized
gguaaaucauggaaucca

SEQ ID NO: 8697 - RNA, 18 nt, artificial
  Chemically synthesized
gagucuuuugaauggaaa

SEQ ID NO: 8698 - RNA, 18 nt, artificial
  Chemically synthesized
ugcuaagggugaguaauu

SEQ ID NO: 8699 - RNA, 18 nt, artificial
  Chemically synthesized
ggcagggaguauacauug

SEQ ID NO: 8700 - RNA, 18 nt, artificial
  Chemically synthesized
agacagagaaaacagaaa

SEQ ID NO: 8701 - RNA, 18 nt, artificial
  Chemically synthesized
cuaccaagccuugaguuu

SEQ ID NO: 8702 - RNA, 18 nt, artificial
  Chemically synthesized
agaaguugaucuaccaag

SEQ ID NO: 8703 - RNA, 18 nt, artificial
  Chemically synthesized
ugagaugaguucucuacu

SEQ ID NO: 8704 - RNA, 18 nt, artificial
  Chemically synthesized
gugcuuguacaguagucu

SEQ ID NO: 8705 - RNA, 18 nt, artificial
  Chemically synthesized
gguucuacaucaaaugcc

SEQ ID NO: 8706 - RNA, 18 nt, artificial
  Chemically synthesized
ggcugguuuagaagucca

SEQ ID NO: 8707 - RNA, 18 nt, artificial
  Chemically synthesized
ccaacucagucaaggaac

SEQ ID NO: 8708 - RNA, 18 nt, artificial
  Chemically synthesized
cagucuucagguacuaaa

SEQ ID NO: 8709 - RNA, 18 nt, artificial
  Chemically synthesized
ggcucgaggaagagaaga

SEQ ID NO: 8710 - RNA, 18 nt, artificial
  Chemically synthesized
caguucuggucuauaagu

SEQ ID NO: 8711 - RNA, 18 nt, artificial
  Chemically synthesized
ggauacguuuccuuauaa

SEQ ID NO: 8712 - RNA, 18 nt, artificial
  Chemically synthesized
gccgaaaggugauuguug

SEQ ID NO: 8713 - RNA, 18 nt, artificial
  Chemically synthesized
agccuugaguuucuagau

SEQ ID NO: 8714 - RNA, 18 nt, artificial
  Chemically synthesized
ccagaacugcuuugaaua

SEQ ID NO: 8715 - RNA, 18 nt, artificial
  Chemically synthesized
gaacuacgugugaaggua

SEQ ID NO: 8716 - RNA, 18 nt, artificial
  Chemically synthesized
gccuauaagcuaauauca

SEQ ID NO: 8717 - RNA, 18 nt, artificial
  Chemically synthesized
uguccagucucgaagucu

SEQ ID NO: 8718 - RNA, 18 nt, artificial
  Chemically synthesized
gcgugagaccagaaagcu

SEQ ID NO: 8719 - RNA, 18 nt, artificial
  Chemically synthesized
gcuaagggugaguaauuc

SEQ ID NO: 8720 - RNA, 18 nt, artificial
  Chemically synthesized
ccucucuaccuuaauauu

SEQ ID NO: 8721 - RNA, 18 nt, artificial
  Chemically synthesized
aguugaucuaccaagccu

SEQ ID NO: 8722 - RNA, 18 nt, artificial
  Chemically synthesized
ggauuuccagcauuccaa

SEQ ID NO: 8723 - RNA, 18 nt, artificial
  Chemically synthesized
gagacaaaucuagcaucu

SEQ ID NO: 8724 - RNA, 18 nt, artificial
  Chemically synthesized
aggucuagggugauugaa

SEQ ID NO: 8725 - RNA, 18 nt, artificial
  Chemically synthesized
ccaacagcauuuaacuca

SEQ ID NO: 8726 - RNA, 18 nt, artificial
  Chemically synthesized
cagaaguugaucuaccaa

SEQ ID NO: 8727 - RNA, 18 nt, artificial
  Chemically synthesized
ccagcaacaagauucaaa

SEQ ID NO: 8728 - RNA, 18 nt, artificial
  Chemically synthesized
gcccagaacugcuuugaa

SEQ ID NO: 8729 - RNA, 18 nt, artificial
  Chemically synthesized
gaguuuccugcaauggau

SEQ ID NO: 8730 - RNA, 18 nt, artificial
  Chemically synthesized
agaugaguucucuacucu

SEQ ID NO: 8731 - RNA, 18 nt, artificial
  Chemically synthesized
ccaugaguucaaacuucu

SEQ ID NO: 8732 - RNA, 18 nt, artificial
  Chemically synthesized
cuugauuccagaaacaua

SEQ ID NO: 8733 - RNA, 18 nt, artificial
  Chemically synthesized
ggcacaucuucuggagac

SEQ ID NO: 8734 - RNA, 18 nt, artificial
  Chemically synthesized
gaguguguuugguuugag

SEQ ID NO: 8735 - RNA, 18 nt, artificial
  Chemically synthesized
aguuucuagaucucagua

SEQ ID NO: 8736 - RNA, 18 nt, artificial
  Chemically synthesized
gucucaaucacauaauga

SEQ ID NO: 8737 - RNA, 18 nt, artificial
  Chemically synthesized
cuccugugacaaaagaga

SEQ ID NO: 8738 - RNA, 18 nt, artificial
  Chemically synthesized
cucagaaugacuuugcuu

SEQ ID NO: 8739 - RNA, 18 nt, artificial
  Chemically synthesized
agagaaaacagaaagaga

SEQ ID NO: 8740 - RNA, 18 nt, artificial
  Chemically synthesized
aguauuuauugcacagac

SEQ ID NO: 8741 - RNA, 18 nt, artificial
  Chemically synthesized
cugagaaacuugaccuuc

SEQ ID NO: 8742 - RNA, 18 nt, artificial
  Chemically synthesized
guuuguuacugaguguuu

SEQ ID NO: 8743 - RNA, 18 nt, artificial
  Chemically synthesized
gacuuugcuuguacuugu

SEQ ID NO: 8744 - RNA, 18 nt, artificial
  Chemically synthesized
cacagagcugagaaacuu

SEQ ID NO: 8745 - RNA, 18 nt, artificial
  Chemically synthesized
ccacuauuuuucaaggaa

SEQ ID NO: 8746 - RNA, 18 nt, artificial
  Chemically synthesized
agaguuuagcccugggag

SEQ ID NO: 8747 - RNA, 18 nt, artificial
  Chemically synthesized
agcugguggcuguggaga

SEQ ID NO: 8748 - RNA, 18 nt, artificial
  Chemically synthesized
gaugguaaaucauggaau

SEQ ID NO: 8749 - RNA, 18 nt, artificial
  Chemically synthesized
gggugauugaacaucccu

SEQ ID NO: 8750 - RNA, 18 nt, artificial
  Chemically synthesized
aggugauuguuguggugu

SEQ ID NO: 8751 - RNA, 18 nt, artificial
  Chemically synthesized
cagugugcuuguaguauc

SEQ ID NO: 8752 - RNA, 18 nt, artificial
  Chemically synthesized
ugaccuuccuggaccucu

SEQ ID NO: 8753 - RNA, 18 nt, artificial
  Chemically synthesized
aagggugaguaauuccau

SEQ ID NO: 8754 - RNA, 18 nt, artificial
  Chemically synthesized
cccuauguaucccuauca

SEQ ID NO: 8755 - RNA, 18 nt, artificial
  Chemically synthesized
gguacuaaauaugagcca

SEQ ID NO: 8756 - RNA, 18 nt, artificial
  Chemically synthesized
cccuuaucccuuaugcuu

SEQ ID NO: 8757 - RNA, 18 nt, artificial
  Chemically synthesized
agaacaacuagaacaucu

SEQ ID NO: 8758 - RNA, 18 nt, artificial
  Chemically synthesized
ggaacacuuaccuggagu

SEQ ID NO: 8759 - RNA, 18 nt, artificial
  Chemically synthesized
ggcugcuaaucucaagga

SEQ ID NO: 8760 - RNA, 18 nt, artificial
  Chemically synthesized
gcugguaucaucuucauu

SEQ ID NO: 8761 - RNA, 18 nt, artificial
  Chemically synthesized
ggcaguuucugagcaguc

SEQ ID NO: 8762 - RNA, 18 nt, artificial
  Chemically synthesized
gagaugaguucucuacuc

SEQ ID NO: 8763 - RNA, 18 nt, artificial
  Chemically synthesized
caaucucucuuuagaccu

SEQ ID NO: 8764 - RNA, 18 nt, artificial
  Chemically synthesized
gcaauuggcaggaagcaa

SEQ ID NO: 8765 - RNA, 18 nt, artificial
  Chemically synthesized
gaccaaucuagagcacuu

SEQ ID NO: 8766 - RNA, 18 nt, artificial
  Chemically synthesized
aauagggaguugucuaau

SEQ ID NO: 8767 - RNA, 18 nt, artificial
  Chemically synthesized
aggagaacuacgugugaa

SEQ ID NO: 8768 - RNA, 18 nt, artificial
  Chemically synthesized
cuaucaaguuuacagaag

SEQ ID NO: 8769 - RNA, 18 nt, artificial
  Chemically synthesized
cccuggugagugugacua

SEQ ID NO: 8770 - RNA, 18 nt, artificial
  Chemically synthesized
aguccagaaugcuaaggu

SEQ ID NO: 8771 - RNA, 18 nt, artificial
  Chemically synthesized
gugaaaacaucuaugaug

SEQ ID NO: 8772 - RNA, 18 nt, artificial
  Chemically synthesized
gugaguaauuccauggug

SEQ ID NO: 8773 - RNA, 18 nt, artificial
  Chemically synthesized
caccagaguuuccugcaa

SEQ ID NO: 8774 - RNA, 18 nt, artificial
  Chemically synthesized
gaugaauaagaccaucau

SEQ ID NO: 8775 - RNA, 18 nt, artificial
  Chemically synthesized
ccuaugaacuuuauccaa

SEQ ID NO: 8776 - RNA, 18 nt, artificial
  Chemically synthesized
gugcauuugugcacauau

SEQ ID NO: 8777 - RNA, 18 nt, artificial
  Chemically synthesized
gaauguucauccagccuc

SEQ ID NO: 8778 - RNA, 18 nt, artificial
  Chemically synthesized
gcuguuugagaugaguuc

SEQ ID NO: 8779 - RNA, 18 nt, artificial
  Chemically synthesized
agaaagagacauuguucu

SEQ ID NO: 8780 - RNA, 18 nt, artificial
  Chemically synthesized
agccgcugguguaucuuu

SEQ ID NO: 8781 - RNA, 18 nt, artificial
  Chemically synthesized
agcaguucuggucuauaa

SEQ ID NO: 8782 - RNA, 18 nt, artificial
  Chemically synthesized
guguguauuugaaagugu

SEQ ID NO: 8783 - RNA, 18 nt, artificial
  Chemically synthesized
ugugaaauccagacaauu

SEQ ID NO: 8784 - RNA, 18 nt, artificial
  Chemically synthesized
caaugugucuggaauuaa

SEQ ID NO: 8785 - RNA, 18 nt, artificial
  Chemically synthesized
ccauuuugguaguuuuga

SEQ ID NO: 8786 - RNA, 18 nt, artificial
  Chemically synthesized
gguucuuauaaagaaggu

SEQ ID NO: 8787 - RNA, 18 nt, artificial
  Chemically synthesized
guuugauggaccucugaa

SEQ ID NO: 8788 - RNA, 18 nt, artificial
  Chemically synthesized
gaagaauuccgauuagca

SEQ ID NO: 8789 - RNA, 18 nt, artificial
  Chemically synthesized
ccauugaagaauuccgau

SEQ ID NO: 8790 - RNA, 18 nt, artificial
  Chemically synthesized
cauggaauccagaaggaa

SEQ ID NO: 8791 - RNA, 18 nt, artificial
  Chemically synthesized
gguuguuuaagacgugcu

SEQ ID NO: 8792 - RNA, 18 nt, artificial
  Chemically synthesized
guauuuauugcacagacu

SEQ ID NO: 8793 - RNA, 18 nt, artificial
  Chemically synthesized
uggacaguuucccacauu

SEQ ID NO: 8794 - RNA, 18 nt, artificial
  Chemically synthesized
gggaaugcuuuuucagaa

SEQ ID NO: 8795 - RNA, 18 nt, artificial
  Chemically synthesized
ccucagaaacagaacauu

SEQ ID NO: 8796 - RNA, 18 nt, artificial
  Chemically synthesized
ggaacaguggguacagga

SEQ ID NO: 8797 - RNA, 18 nt, artificial
  Chemically synthesized
ugcugaguuugaauauca

SEQ ID NO: 8798 - RNA, 18 nt, artificial
  Chemically synthesized
ugauuacagucucaauca

SEQ ID NO: 8799 - RNA, 18 nt, artificial
  Chemically synthesized
ggauggcaacauuuagaa

SEQ ID NO: 8800 - RNA, 18 nt, artificial
  Chemically synthesized
agggaguugucuaauugg

SEQ ID NO: 8801 - RNA, 18 nt, artificial
  Chemically synthesized
agacgugcuucaaauauc

SEQ ID NO: 8802 - RNA, 18 nt, artificial
  Chemically synthesized
ccugucagaugaauaaga

SEQ ID NO: 8803 - RNA, 18 nt, artificial
  Chemically synthesized
caaccagccuaaaguauu

SEQ ID NO: 8804 - RNA, 18 nt, artificial
  Chemically synthesized
gcuucaaugguguuauua

SEQ ID NO: 8805 - RNA, 18 nt, artificial
  Chemically synthesized
agucagaaguguuuguua

SEQ ID NO: 8806 - RNA, 18 nt, artificial
  Chemically synthesized
aagccuugaguuucuaga

SEQ ID NO: 8807 - RNA, 18 nt, artificial
  Chemically synthesized
agaauuccgauuagcaua

SEQ ID NO: 8808 - RNA, 18 nt, artificial
  Chemically synthesized
guguccgcaugaucauau

SEQ ID NO: 8809 - RNA, 18 nt, artificial
  Chemically synthesized
ggguaaggaaugagcuag

SEQ ID NO: 8810 - RNA, 18 nt, artificial
  Chemically synthesized
ccuggugagugugacuau

SEQ ID NO: 8811 - RNA, 18 nt, artificial
  Chemically synthesized
guauuuagaucugagcuu

SEQ ID NO: 8812 - RNA, 18 nt, artificial
  Chemically synthesized
ccagcuggguccaacacu

SEQ ID NO: 8813 - RNA, 18 nt, artificial
  Chemically synthesized
ggcuuguccagucucgaa

SEQ ID NO: 8814 - RNA, 18 nt, artificial
  Chemically synthesized
cuugauuacagucucaau

SEQ ID NO: 8815 - RNA, 18 nt, artificial
  Chemically synthesized
cuguauagaagagagugu

SEQ ID NO: 8816 - RNA, 18 nt, artificial
  Chemically synthesized
accagaguuuccugcaau

SEQ ID NO: 8817 - RNA, 18 nt, artificial
  Chemically synthesized
ccucauuuaccuugacau

SEQ ID NO: 8818 - RNA, 18 nt, artificial
  Chemically synthesized
cuaccucgaugauauuau

SEQ ID NO: 8819 - RNA, 18 nt, artificial
  Chemically synthesized
gccugugcugaguuugaa

SEQ ID NO: 8820 - RNA, 18 nt, artificial
  Chemically synthesized
cgauuagcauacuuagac

SEQ ID NO: 8821 - RNA, 18 nt, artificial
  Chemically synthesized
ggaugcaauuggcaggaa

SEQ ID NO: 8822 - RNA, 18 nt, artificial
  Chemically synthesized
cuguggagacaaaucuag

SEQ ID NO: 8823 - RNA, 18 nt, artificial
  Chemically synthesized
cuuagaacaacuagaaca

SEQ ID NO: 8824 - RNA, 18 nt, artificial
  Chemically synthesized
aucuguuguagcaguucu

SEQ ID NO: 8825 - RNA, 18 nt, artificial
  Chemically synthesized
cuagcaucucuagagaac

SEQ ID NO: 8826 - RNA, 18 nt, artificial
  Chemically synthesized
ccauggugcacuagauau

SEQ ID NO: 8827 - RNA, 18 nt, artificial
  Chemically synthesized
cuguaaauuuggacaguu

SEQ ID NO: 8828 - RNA, 18 nt, artificial
  Chemically synthesized
gugugaaauccagacaau

SEQ ID NO: 8829 - RNA, 18 nt, artificial
  Chemically synthesized
caaggagcuuccagugca

SEQ ID NO: 8830 - RNA, 18 nt, artificial
  Chemically synthesized
acuuucacuuccaacaaa

SEQ ID NO: 8831 - RNA, 18 nt, artificial
  Chemically synthesized
ggaaaaguuugacaaauc

SEQ ID NO: 8832 - RNA, 18 nt, artificial
  Chemically synthesized
cugugcaauuugaccauu

SEQ ID NO: 8833 - RNA, 18 nt, artificial
  Chemically synthesized
ggcuggcaauucuuucca

SEQ ID NO: 8834 - RNA, 18 nt, artificial
  Chemically synthesized
ggaguauacauugcuguu

SEQ ID NO: 8835 - RNA, 18 nt, artificial
  Chemically synthesized
ccagauaucuucacagag

SEQ ID NO: 8836 - RNA, 18 nt, artificial
  Chemically synthesized
gcagcagaaguuuauuuu

SEQ ID NO: 8837 - RNA, 18 nt, artificial
  Chemically synthesized
gcaggaaggaagugggau

SEQ ID NO: 8838 - RNA, 18 nt, artificial
  Chemically synthesized
guucuggucuauaaguuc

SEQ ID NO: 8839 - RNA, 18 nt, artificial
  Chemically synthesized
ggagcuuccagugcagag

SEQ ID NO: 8840 - RNA, 18 nt, artificial
  Chemically synthesized
gggagacacagauggcug

SEQ ID NO: 8841 - RNA, 18 nt, artificial
  Chemically synthesized
accucucuaccuuaauau

SEQ ID NO: 8842 - RNA, 18 nt, artificial
  Chemically synthesized
ccacauugaaacucaaau

SEQ ID NO: 8843 - RNA, 18 nt, artificial
  Chemically synthesized
ggagcuguaccgccuucu

SEQ ID NO: 8844 - RNA, 18 nt, artificial
  Chemically synthesized
ggucuggcugguuuagaa

SEQ ID NO: 8845 - RNA, 18 nt, artificial
  Chemically synthesized
caguuucccacauugaaa

SEQ ID NO: 8846 - RNA, 18 nt, artificial
  Chemically synthesized
ggguucuacaucaaaugc

SEQ ID NO: 8847 - RNA, 18 nt, artificial
  Chemically synthesized
ccaagccuugaguuucua

SEQ ID NO: 8848 - RNA, 18 nt, artificial
  Chemically synthesized
agacuaaaauacagaguc

SEQ ID NO: 8849 - RNA, 18 nt, artificial
  Chemically synthesized
gcugcuaaucucaaggag

SEQ ID NO: 8850 - RNA, 18 nt, artificial
  Chemically synthesized
uggagaagacccugcuca

SEQ ID NO: 8851 - RNA, 18 nt, artificial
  Chemically synthesized
ucagugugcuuguaguau

SEQ ID NO: 8852 - RNA, 18 nt, artificial
  Chemically synthesized
cugccuucacuacagaga

SEQ ID NO: 8853 - RNA, 18 nt, artificial
  Chemically synthesized
cuaugaacuuuauccaac

SEQ ID NO: 8854 - RNA, 18 nt, artificial
  Chemically synthesized
gggaagaguggauguuau

SEQ ID NO: 8855 - RNA, 18 nt, artificial
  Chemically synthesized
cauccagaguuuagcccu

SEQ ID NO: 8856 - RNA, 18 nt, artificial
  Chemically synthesized
gcagaagguggagaagac

SEQ ID NO: 8857 - RNA, 18 nt, artificial
  Chemically synthesized
gguggagaagacccugcu

SEQ ID NO: 8858 - RNA, 18 nt, artificial
  Chemically synthesized
ggccauugcugccaacau

SEQ ID NO: 8859 - RNA, 18 nt, artificial
  Chemically synthesized
auagggaguugucuaauu

SEQ ID NO: 8860 - RNA, 18 nt, artificial
  Chemically synthesized
uccgcuuccuggucuuau

SEQ ID NO: 8861 - RNA, 18 nt, artificial
  Chemically synthesized
cagucaaggaacccauga

SEQ ID NO: 8862 - RNA, 18 nt, artificial
  Chemically synthesized
gcacauaucccuauguau

SEQ ID NO: 8863 - RNA, 18 nt, artificial
  Chemically synthesized
cuggugagugugacuauu

SEQ ID NO: 8864 - RNA, 18 nt, artificial
  Chemically synthesized
gcuagaggcaggaaggaa

SEQ ID NO: 8865 - RNA, 18 nt, artificial
  Chemically synthesized
ggaaacuuggaaaaguuu

SEQ ID NO: 8866 - RNA, 18 nt, artificial
  Chemically synthesized
cuugaagaauacauccau

SEQ ID NO: 8867 - RNA, 18 nt, artificial
  Chemically synthesized
aguagaaauggcuugagu

SEQ ID NO: 8868 - RNA, 18 nt, artificial
  Chemically synthesized
gucagaugaauaagacca

SEQ ID NO: 8869 - RNA, 18 nt, artificial
  Chemically synthesized
gaacaagugauguuugau

SEQ ID NO: 8870 - RNA, 18 nt, artificial
  Chemically synthesized
ugcuuugaauacaccaau

SEQ ID NO: 8871 - RNA, 18 nt, artificial
  Chemically synthesized
guuacugaguguuucaga

SEQ ID NO: 8872 - RNA, 18 nt, artificial
  Chemically synthesized
gaaacaaaaguccagaau

SEQ ID NO: 8873 - RNA, 18 nt, artificial
  Chemically synthesized
gacugaacuggguguuca

SEQ ID NO: 8874 - RNA, 18 nt, artificial
  Chemically synthesized
gucacuuugucacucgau

SEQ ID NO: 8875 - RNA, 18 nt, artificial
  Chemically synthesized
cggcacaucuucuggaga

SEQ ID NO: 8876 - RNA, 18 nt, artificial
  Chemically synthesized
gaaugacuuugcuuguac

SEQ ID NO: 8877 - RNA, 18 nt, artificial
  Chemically synthesized
gaguuucaaagguugcug

SEQ ID NO: 8878 - RNA, 18 nt, artificial
  Chemically synthesized
aguucuauuuucaccuga

SEQ ID NO: 8879 - RNA, 18 nt, artificial
  Chemically synthesized
guugaucuaccaagccuu

SEQ ID NO: 8880 - RNA, 18 nt, artificial
  Chemically synthesized
ccauuggacaucucaaaa

SEQ ID NO: 8881 - RNA, 18 nt, artificial
  Chemically synthesized
cuagaucucaguagaaau

SEQ ID NO: 8882 - RNA, 18 nt, artificial
  Chemically synthesized
ggguguucacuuuuuccu

SEQ ID NO: 8883 - RNA, 18 nt, artificial
  Chemically synthesized
agaccaucauuggugugu

SEQ ID NO: 8884 - RNA, 18 nt, artificial
  Chemically synthesized
gaaagucauuucaacucu

SEQ ID NO: 8885 - RNA, 18 nt, artificial
  Chemically synthesized
agaacuuaauguggcuca

SEQ ID NO: 8886 - RNA, 18 nt, artificial
  Chemically synthesized
gacuugcggguucuacau

SEQ ID NO: 8887 - RNA, 18 nt, artificial
  Chemically synthesized
caaccauccuggucauuc

SEQ ID NO: 8888 - RNA, 18 nt, artificial
  Chemically synthesized
agaacaucuggauuucca

SEQ ID NO: 8889 - RNA, 18 nt, artificial
  Chemically synthesized
gauugaacaucccugggu

SEQ ID NO: 8890 - RNA, 18 nt, artificial
  Chemically synthesized
gaugcuucuugcuggcug

SEQ ID NO: 8891 - RNA, 18 nt, artificial
  Chemically synthesized
caccucucuaccuuaaua

SEQ ID NO: 8892 - RNA, 18 nt, artificial
  Chemically synthesized
cugguaucaucuucauug

SEQ ID NO: 8893 - RNA, 18 nt, artificial
  Chemically synthesized
gguauucaaggcagggag

SEQ ID NO: 8894 - RNA, 18 nt, artificial
  Chemically synthesized
ggcuuagaacaacuagaa

SEQ ID NO: 8895 - RNA, 18 nt, artificial
  Chemically synthesized
agaaugacuuugcuugua

SEQ ID NO: 8896 - RNA, 18 nt, artificial
  Chemically synthesized
gccgcuuucacuuccucu

SEQ ID NO: 8897 - RNA, 18 nt, artificial
  Chemically synthesized
gaccacagucagaagugu

SEQ ID NO: 8898 - RNA, 18 nt, artificial
  Chemically synthesized
gggugaguaauuccaugg

SEQ ID NO: 8899 - RNA, 18 nt, artificial
  Chemically synthesized
gaauccagaaggaacagu

SEQ ID NO: 8900 - RNA, 18 nt, artificial
  Chemically synthesized
guggagacaaaucuagca

SEQ ID NO: 8901 - RNA, 18 nt, artificial
  Chemically synthesized
guuuccaugucucaugua

SEQ ID NO: 8902 - RNA, 18 nt, artificial
  Chemically synthesized
gauggcaacauuuagaau

SEQ ID NO: 8903 - RNA, 18 nt, artificial
  Chemically synthesized
ccacauuuugggaagagu

SEQ ID NO: 8904 - RNA, 18 nt, artificial
  Chemically synthesized
cuugaguuucaaagguug

SEQ ID NO: 8905 - RNA, 18 nt, artificial
  Chemically synthesized
ugguucugggagaauuua

SEQ ID NO: 8906 - RNA, 18 nt, artificial
  Chemically synthesized
uucacuacagagacuuua

SEQ ID NO: 8907 - RNA, 18 nt, artificial
  Chemically synthesized
aacuuguauucaaggucu

SEQ ID NO: 8908 - RNA, 18 nt, artificial
  Chemically synthesized
cauugaaacucaaaucuc

SEQ ID NO: 8909 - RNA, 18 nt, artificial
  Chemically synthesized
agcccugcguggaggugu

SEQ ID NO: 8910 - RNA, 18 nt, artificial
  Chemically synthesized
cacccuuuagcccagaac

SEQ ID NO: 8911 - RNA, 18 nt, artificial
  Chemically synthesized
gguaucaucuucauuguc

SEQ ID NO: 8912 - RNA, 18 nt, artificial
  Chemically synthesized
ccacagucagaaguguuu

SEQ ID NO: 8913 - RNA, 18 nt, artificial
  Chemically synthesized
aguacacucugucacuuu

SEQ ID NO: 8914 - RNA, 18 nt, artificial
  Chemically synthesized
ggcuucauaagcugacuu

SEQ ID NO: 8915 - RNA, 18 nt, artificial
  Chemically synthesized
ccuuauaagugucugaac

SEQ ID NO: 8916 - RNA, 18 nt, artificial
  Chemically synthesized
acuuaauguggcucacaa

SEQ ID NO: 8917 - RNA, 18 nt, artificial
  Chemically synthesized
gaguuugaauaucaccug

SEQ ID NO: 8918 - RNA, 18 nt, artificial
  Chemically synthesized
cugguguaucuuugaaua

SEQ ID NO: 8919 - RNA, 18 nt, artificial
  Chemically synthesized
guaucaucuucauugucc

SEQ ID NO: 8920 - RNA, 18 nt, artificial
  Chemically synthesized
gaaaacagaaagagacau

SEQ ID NO: 8921 - RNA, 18 nt, artificial
  Chemically synthesized
ggaggugugaaauccaga

SEQ ID NO: 8922 - RNA, 18 nt, artificial
  Chemically synthesized
acuacuaccucgaugaua

SEQ ID NO: 8923 - RNA, 18 nt, artificial
  Chemically synthesized
cagcauuccaauuugaaa

SEQ ID NO: 8924 - RNA, 18 nt, artificial
  Chemically synthesized
guucuuuuccugagucuu

SEQ ID NO: 8925 - RNA, 18 nt, artificial
  Chemically synthesized
gguguucacuuuuuccuu

SEQ ID NO: 8926 - RNA, 18 nt, artificial
  Chemically synthesized
gacaaaucugcucuagag

SEQ ID NO: 8927 - RNA, 18 nt, artificial
  Chemically synthesized
ucuugugcuuguacagua

SEQ ID NO: 8928 - RNA, 18 nt, artificial
  Chemically synthesized
ggcauaucagagccuaag

SEQ ID NO: 8929 - RNA, 18 nt, artificial
  Chemically synthesized
cacuauuuuucaaggaag

SEQ ID NO: 8930 - RNA, 18 nt, artificial
  Chemically synthesized
ggcagcucuugguggaag

SEQ ID NO: 8931 - RNA, 18 nt, artificial
  Chemically synthesized
uguagcaguucuggucua

SEQ ID NO: 8932 - RNA, 18 nt, artificial
  Chemically synthesized
gucuucagguacuaaaua

SEQ ID NO: 8933 - RNA, 18 nt, artificial
  Chemically synthesized
ucuugauuacagucucaa

SEQ ID NO: 8934 - RNA, 18 nt, artificial
  Chemically synthesized
ucucgagcauguucuauu

SEQ ID NO: 8935 - RNA, 18 nt, artificial
  Chemically synthesized
caguagaaauggcuugag

SEQ ID NO: 8936 - RNA, 18 nt, artificial
  Chemically synthesized
ggagaacuacgugugaag

SEQ ID NO: 8937 - RNA, 18 nt, artificial
  Chemically synthesized
ccaugacaaagaaaguca

SEQ ID NO: 8938 - RNA, 18 nt, artificial
  Chemically synthesized
ccagguucuugauuacag

SEQ ID NO: 8939 - RNA, 18 nt, artificial
  Chemically synthesized
ggacaauuugggcuagag

SEQ ID NO: 8940 - RNA, 18 nt, artificial
  Chemically synthesized
ugcuguucucaaagugau

SEQ ID NO: 8941 - RNA, 18 nt, artificial
  Chemically synthesized
guggguacaggaugcaau

SEQ ID NO: 8942 - RNA, 18 nt, artificial
  Chemically synthesized
agaugaauaagaccauca

SEQ ID NO: 8943 - RNA, 18 nt, artificial
  Chemically synthesized
uggagacgacucagaaaa

SEQ ID NO: 8944 - RNA, 18 nt, artificial
  Chemically synthesized
guaugguagaggugaaaa

SEQ ID NO: 8945 - RNA, 18 nt, artificial
  Chemically synthesized
caggugcauuuaaagaaa

SEQ ID NO: 8946 - RNA, 18 nt, artificial
  Chemically synthesized
gagccgcugguguaucuu

SEQ ID NO: 8947 - RNA, 18 nt, artificial
  Chemically synthesized
ugagugaguuuucaguau

SEQ ID NO: 8948 - RNA, 18 nt, artificial
  Chemically synthesized
caaguagucuagcuuucu

SEQ ID NO: 8949 - RNA, 18 nt, artificial
  Chemically synthesized
gaaauaugaccacaguca

SEQ ID NO: 8950 - RNA, 18 nt, artificial
  Chemically synthesized
gugugaagguauucaagg

SEQ ID NO: 8951 - RNA, 18 nt, artificial
  Chemically synthesized
gaacccaugacaaagaaa

SEQ ID NO: 8952 - RNA, 18 nt, artificial
  Chemically synthesized
guucaaacuucuugggcu

SEQ ID NO: 8953 - RNA, 18 nt, artificial
  Chemically synthesized
cccagaaaagaauguuca

SEQ ID NO: 8954 - RNA, 18 nt, artificial
  Chemically synthesized
gaggaagagaagacacca

SEQ ID NO: 8955 - RNA, 18 nt, artificial
  Chemically synthesized
gcuuguccagucucgaag

SEQ ID NO: 8956 - RNA, 18 nt, artificial
  Chemically synthesized
gguguuauuaccaugagu

SEQ ID NO: 8957 - RNA, 18 nt, artificial
  Chemically synthesized
aggcagggaguauacauu

SEQ ID NO: 8958 - RNA, 18 nt, artificial
  Chemically synthesized
ucucaaaaggcuuacuuu

SEQ ID NO: 8959 - RNA, 18 nt, artificial
  Chemically synthesized
gagugugacuauugaaag

SEQ ID NO: 8960 - RNA, 18 nt, artificial
  Chemically synthesized
acuagaacaucuggauuu

SEQ ID NO: 8961 - RNA, 18 nt, artificial
  Chemically synthesized
gaggacuggguaaggaau

SEQ ID NO: 8962 - RNA, 18 nt, artificial
  Chemically synthesized
acgugugaagguauucaa

SEQ ID NO: 8963 - RNA, 18 nt, artificial
  Chemically synthesized
agaccuggcaguuucuga

SEQ ID NO: 8964 - RNA, 18 nt, artificial
  Chemically synthesized
cucucagugucaacugga

SEQ ID NO: 8965 - RNA, 18 nt, artificial
  Chemically synthesized
uagaagagagugugauua

SEQ ID NO: 8966 - RNA, 18 nt, artificial
  Chemically synthesized
gccuucacuacagagacu

SEQ ID NO: 8967 - RNA, 18 nt, artificial
  Chemically synthesized
guagaaauggcuugaguu

SEQ ID NO: 8968 - RNA, 18 nt, artificial
  Chemically synthesized
gcacagacuugcggguuc

SEQ ID NO: 8969 - RNA, 18 nt, artificial
  Chemically synthesized
cuaucagggcugugugua

SEQ ID NO: 8970 - RNA, 18 nt, artificial
  Chemically synthesized
gaguugcuuucaauggca

SEQ ID NO: 8971 - RNA, 18 nt, artificial
  Chemically synthesized
cugugcugaguuugaaua

SEQ ID NO: 8972 - RNA, 18 nt, artificial
  Chemically synthesized
ggguccaacacuuguuca

SEQ ID NO: 8973 - RNA, 18 nt, artificial
  Chemically synthesized
ggcggcacaucuucugga

SEQ ID NO: 8974 - RNA, 18 nt, artificial
  Chemically synthesized
ugaguucucuacucuugu

SEQ ID NO: 8975 - RNA, 18 nt, artificial
  Chemically synthesized
ggagacgacucagaaaag

SEQ ID NO: 8976 - RNA, 18 nt, artificial
  Chemically synthesized
cccuggguguguuuccau

SEQ ID NO: 8977 - RNA, 18 nt, artificial
  Chemically synthesized
gcuuguacuugugaacac

SEQ ID NO: 8978 - RNA, 18 nt, artificial
  Chemically synthesized
gcuuugaauacaccaauu

SEQ ID NO: 8979 - RNA, 18 nt, artificial
  Chemically synthesized
uauagaagagagugugau

SEQ ID NO: 8980 - RNA, 18 nt, artificial
  Chemically synthesized
ugaacuggguguucacuu

SEQ ID NO: 8981 - RNA, 18 nt, artificial
  Chemically synthesized
ugacuuugcuuguacuug

SEQ ID NO: 8982 - RNA, 18 nt, artificial
  Chemically synthesized
cagggaguauacauugcu

SEQ ID NO: 8983 - RNA, 18 nt, artificial
  Chemically synthesized
caaggaacccaugacaaa

SEQ ID NO: 8984 - RNA, 18 nt, artificial
  Chemically synthesized
gaacauucaagaaaagga

SEQ ID NO: 8985 - RNA, 18 nt, artificial
  Chemically synthesized
guccagucucgaagucuu

SEQ ID NO: 8986 - RNA, 18 nt, artificial
  Chemically synthesized
gcuguuucuuuagccacu

SEQ ID NO: 8987 - RNA, 18 nt, artificial
  Chemically synthesized
uccaaguagucuagcuuu

SEQ ID NO: 8988 - RNA, 18 nt, artificial
  Chemically synthesized
ugacauuucucauacuca

SEQ ID NO: 8989 - RNA, 18 nt, artificial
  Chemically synthesized
guucuauuuucaccugau

SEQ ID NO: 8990 - RNA, 18 nt, artificial
  Chemically synthesized
cugcgugagaccagaaag

SEQ ID NO: 8991 - RNA, 18 nt, artificial
  Chemically synthesized
caaaggugggaaugcuuu

SEQ ID NO: 8992 - RNA, 18 nt, artificial
  Chemically synthesized
ccaacaucauccaugaag

SEQ ID NO: 8993 - RNA, 18 nt, artificial
  Chemically synthesized
cuaccuuaauauugacag

SEQ ID NO: 8994 - RNA, 18 nt, artificial
  Chemically synthesized
caacaucuaucugaagag

SEQ ID NO: 8995 - RNA, 18 nt, artificial
  Chemically synthesized
cagaguuuagcccuggga

SEQ ID NO: 8996 - RNA, 18 nt, artificial
  Chemically synthesized
gccugugcaauuugacca

SEQ ID NO: 8997 - RNA, 18 nt, artificial
  Chemically synthesized
ggugauuguugugguguc

SEQ ID NO: 8998 - RNA, 18 nt, artificial
  Chemically synthesized
uggacaucucaaaacuuu

SEQ ID NO: 8999 - RNA, 18 nt, artificial
  Chemically synthesized
cucaaucucucuuuagac

SEQ ID NO: 9000 - RNA, 18 nt, artificial
  Chemically synthesized
cuuugucacucgauguca

SEQ ID NO: 9001 - RNA, 18 nt, artificial
  Chemically synthesized
cuuggaccuuuccagcaa

SEQ ID NO: 9002 - RNA, 18 nt, artificial
  Chemically synthesized
guauagaagagaguguga

SEQ ID NO: 9003 - RNA, 18 nt, artificial
  Chemically synthesized
ccugcagaagguggagaa

SEQ ID NO: 9004 - RNA, 18 nt, artificial
  Chemically synthesized
ggguucuuauaaagaagg

SEQ ID NO: 9005 - RNA, 18 nt, artificial
  Chemically synthesized
gaugcaauuggcaggaag

SEQ ID NO: 9006 - RNA, 18 nt, artificial
  Chemically synthesized
ggagaagacccugcucag

SEQ ID NO: 9007 - RNA, 18 nt, artificial
  Chemically synthesized
gcuagacuaaaauacaga

SEQ ID NO: 9008 - RNA, 18 nt, artificial
  Chemically synthesized
ggaugguaaaucauggaa

SEQ ID NO: 9009 - RNA, 18 nt, artificial
  Chemically synthesized
cagggcugcuaaucucaa

SEQ ID NO: 9010 - RNA, 18 nt, artificial
  Chemically synthesized
gguacaggaugcaauugg

SEQ ID NO: 9011 - RNA, 18 nt, artificial
  Chemically synthesized
ccuuaucccuuaugcuug

SEQ ID NO: 9012 - RNA, 18 nt, artificial
  Chemically synthesized
cauccaugaagguuucca

SEQ ID NO: 9013 - RNA, 18 nt, artificial
  Chemically synthesized
gacuaaaauacagagucu

SEQ ID NO: 9014 - RNA, 18 nt, artificial
  Chemically synthesized
cgugagaccagaaagcug

SEQ ID NO: 9015 - RNA, 18 nt, artificial
  Chemically synthesized
cauugagaaaacaaugug

SEQ ID NO: 9016 - RNA, 18 nt, artificial
  Chemically synthesized
ccuugacauuucucauac

SEQ ID NO: 9017 - RNA, 18 nt, artificial
  Chemically synthesized
gucuagggugauugaaca

SEQ ID NO: 9018 - RNA, 18 nt, artificial
  Chemically synthesized
ggaugaugccaggaugau

SEQ ID NO: 9019 - RNA, 18 nt, artificial
  Chemically synthesized
cugucaugaaagcagcau

SEQ ID NO: 9020 - RNA, 18 nt, artificial
  Chemically synthesized
aguugcagcagaaguuua

SEQ ID NO: 9021 - RNA, 18 nt, artificial
  Chemically synthesized
cugcuuugaauacaccaa

SEQ ID NO: 9022 - RNA, 18 nt, artificial
  Chemically synthesized
cugucagaugaauaagac

SEQ ID NO: 9023 - RNA, 18 nt, artificial
  Chemically synthesized
uaagguuguuuaagacgu

SEQ ID NO: 9024 - RNA, 18 nt, artificial
  Chemically synthesized
aguucuggucuauaaguu

SEQ ID NO: 9025 - RNA, 18 nt, artificial
  Chemically synthesized
ggaagugggaugaccuca

SEQ ID NO: 9026 - RNA, 18 nt, artificial
  Chemically synthesized
cucucacccuuuagccca

SEQ ID NO: 9027 - RNA, 18 nt, artificial
  Chemically synthesized
gccaggagaacuacgugu

SEQ ID NO: 9028 - RNA, 18 nt, artificial
  Chemically synthesized
caaggcagggaguauaca

SEQ ID NO: 9029 - RNA, 18 nt, artificial
  Chemically synthesized
ccuacuaaguaaugacug

SEQ ID NO: 9030 - RNA, 18 nt, artificial
  Chemically synthesized
auuacagucucaaucaca

SEQ ID NO: 9031 - RNA, 18 nt, artificial
  Chemically synthesized
gagacuuuauucccggug

SEQ ID NO: 9032 - RNA, 18 nt, artificial
  Chemically synthesized
cauuuaacucacucucca

SEQ ID NO: 9033 - RNA, 18 nt, artificial
  Chemically synthesized
cuuccuuccagauaucuu

SEQ ID NO: 9034 - RNA, 18 nt, artificial
  Chemically synthesized
cuguucucaaagugauuu

SEQ ID NO: 9035 - RNA, 18 nt, artificial
  Chemically synthesized
gaagagaagacaccagug

SEQ ID NO: 9036 - RNA, 18 nt, artificial
  Chemically synthesized
gggacaaccagccuaaag

SEQ ID NO: 9037 - RNA, 18 nt, artificial
  Chemically synthesized
guccaacacuuguucagu

SEQ ID NO: 9038 - RNA, 18 nt, artificial
  Chemically synthesized
cuacagagacuuuauucc

SEQ ID NO: 9039 - RNA, 18 nt, artificial
  Chemically synthesized
ggacucugaucccagcca

SEQ ID NO: 9040 - RNA, 18 nt, artificial
  Chemically synthesized
gugaagguauucaaggca

SEQ ID NO: 9041 - RNA, 18 nt, artificial
  Chemically synthesized
cucgaggaagagaagaca

SEQ ID NO: 9042 - RNA, 18 nt, artificial
  Chemically synthesized
gcugcucacagaagcagu

SEQ ID NO: 9043 - RNA, 18 nt, artificial
  Chemically synthesized
ggugauugaacaucccug

SEQ ID NO: 9044 - RNA, 18 nt, artificial
  Chemically synthesized
cucacaccagaguugcuu

SEQ ID NO: 9045 - RNA, 18 nt, artificial
  Chemically synthesized
cagaaggaacagugggua

SEQ ID NO: 9046 - RNA, 18 nt, artificial
  Chemically synthesized
uugaguuucuagaucuca

SEQ ID NO: 9047 - RNA, 18 nt, artificial
  Chemically synthesized
gugcuucaaauauccaua

SEQ ID NO: 9048 - RNA, 18 nt, artificial
  Chemically synthesized
gccuccucagaaacagaa

SEQ ID NO: 9049 - RNA, 18 nt, artificial
  Chemically synthesized
cacaucuucuggagacga

SEQ ID NO: 9050 - RNA, 18 nt, artificial
  Chemically synthesized
ccaucauuggugugucgg

SEQ ID NO: 9051 - RNA, 18 nt, artificial
  Chemically synthesized
cucagaccuggcaguuuc

SEQ ID NO: 9052 - RNA, 18 nt, artificial
  Chemically synthesized
aggccuuaugcuaagggu

SEQ ID NO: 9053 - RNA, 18 nt, artificial
  Chemically synthesized
agaaguguuuguuacuga

SEQ ID NO: 9054 - RNA, 18 nt, artificial
  Chemically synthesized
ccuuaugcuaagggugag

SEQ ID NO: 9055 - RNA, 18 nt, artificial
  Chemically synthesized
cagcauuuaacucacucu

SEQ ID NO: 9056 - RNA, 18 nt, artificial
  Chemically synthesized
gccacaacaacuucuuuu

SEQ ID NO: 9057 - RNA, 18 nt, artificial
  Chemically synthesized
cagaaagagacauuguuc

SEQ ID NO: 9058 - RNA, 18 nt, artificial
  Chemically synthesized
gagacauuguucuuuucc

SEQ ID NO: 9059 - RNA, 18 nt, artificial
  Chemically synthesized
cugugacaaaagagauaa

SEQ ID NO: 9060 - RNA, 18 nt, artificial
  Chemically synthesized
gcuaauuccuaaggaaac

SEQ ID NO: 9061 - RNA, 18 nt, artificial
  Chemically synthesized
ugaauaagaccaucauug

SEQ ID NO: 9062 - RNA, 18 nt, artificial
  Chemically synthesized
cccugaacccuaugaacu

SEQ ID NO: 9063 - RNA, 18 nt, artificial
  Chemically synthesized
ugugcugaguuugaauau

SEQ ID NO: 9064 - RNA, 18 nt, artificial
  Chemically synthesized
ugcuuguacuugugaaca

SEQ ID NO: 9065 - RNA, 18 nt, artificial
  Chemically synthesized
gaccucucucagugucaa

SEQ ID NO: 9066 - RNA, 18 nt, artificial
  Chemically synthesized
guaaauuuggacaguuuc

SEQ ID NO: 9067 - RNA, 18 nt, artificial
  Chemically synthesized
caucuaugaugccuuugu

SEQ ID NO: 9068 - RNA, 18 nt, artificial
  Chemically synthesized
cagaagguggagaagacc

SEQ ID NO: 9069 - RNA, 18 nt, artificial
  Chemically synthesized
cauucaagaaaaggacaa

SEQ ID NO: 9070 - RNA, 18 nt, artificial
  Chemically synthesized
cuugaaaauggcuggcaa

SEQ ID NO: 9071 - RNA, 18 nt, artificial
  Chemically synthesized
guacuugugaacaccaga

SEQ ID NO: 9072 - RNA, 18 nt, artificial
  Chemically synthesized
guguuauuaccaugaguu

SEQ ID NO: 9073 - RNA, 18 nt, artificial
  Chemically synthesized
ggaaggaagugggaugac

SEQ ID NO: 9074 - RNA, 18 nt, artificial
  Chemically synthesized
gucuagcuuucuuaaauc

SEQ ID NO: 9075 - RNA, 18 nt, artificial
  Chemically synthesized
cuagggugauugaacauc

SEQ ID NO: 9076 - RNA, 18 nt, artificial
  Chemically synthesized
guguguuugguuugagca

SEQ ID NO: 9077 - RNA, 18 nt, artificial
  Chemically synthesized
guguguguguccgcauga

SEQ ID NO: 9078 - RNA, 18 nt, artificial
  Chemically synthesized
cagaguugcuuucaaugg

SEQ ID NO: 9079 - RNA, 18 nt, artificial
  Chemically synthesized
cgcugguguaucuuugaa

SEQ ID NO: 9080 - RNA, 18 nt, artificial
  Chemically synthesized
agcucugccuucacuaca

SEQ ID NO: 9081 - RNA, 18 nt, artificial
  Chemically synthesized
auuccauggugcacuaga

SEQ ID NO: 9082 - RNA, 18 nt, artificial
  Chemically synthesized
gucagacggugauagcga

SEQ ID NO: 9083 - RNA, 18 nt, artificial
  Chemically synthesized
ggugugucgguccucagu

SEQ ID NO: 9084 - RNA, 18 nt, artificial
  Chemically synthesized
cagagacuuuauucccgg

SEQ ID NO: 9085 - RNA, 18 nt, artificial
  Chemically synthesized
ucuaaucugaccaaucua

SEQ ID NO: 9086 - RNA, 18 nt, artificial
  Chemically synthesized
gaauaucaccugucagau

SEQ ID NO: 9087 - RNA, 18 nt, artificial
  Chemically synthesized
agccgaaaggugauuguu

SEQ ID NO: 9088 - RNA, 18 nt, artificial
  Chemically synthesized
cacagaagcagugaggau

SEQ ID NO: 9089 - RNA, 18 nt, artificial
  Chemically synthesized
ucuagcaucucuagagaa

SEQ ID NO: 9090 - RNA, 18 nt, artificial
  Chemically synthesized
ggcauuucuugcccagcu

SEQ ID NO: 9091 - RNA, 18 nt, artificial
  Chemically synthesized
gcuuacuuucacuuccaa

SEQ ID NO: 9092 - RNA, 18 nt, artificial
  Chemically synthesized
ccuggcaguuucugagca

SEQ ID NO: 9093 - RNA, 18 nt, artificial
  Chemically synthesized
gcugguuuagaaguccau

SEQ ID NO: 9094 - RNA, 18 nt, artificial
  Chemically synthesized
cagugcagagggaauaaa

SEQ ID NO: 9095 - RNA, 18 nt, artificial
  Chemically synthesized
gaagguggagaagacccu

SEQ ID NO: 9096 - RNA, 18 nt, artificial
  Chemically synthesized
gggcauaucagagccuaa

SEQ ID NO: 9097 - RNA, 18 nt, artificial
  Chemically synthesized
gcggcucgaggaagagaa

SEQ ID NO: 9098 - RNA, 18 nt, artificial
  Chemically synthesized
cgcaugaucauaucugua

SEQ ID NO: 9099 - RNA, 18 nt, artificial
  Chemically synthesized
cucagucaaggaacccau

SEQ ID NO: 9100 - RNA, 18 nt, artificial
  Chemically synthesized
gagcaguugucuccaaca

SEQ ID NO: 9101 - RNA, 18 nt, artificial
  Chemically synthesized
aggugaaaacaucuauga

SEQ ID NO: 9102 - RNA, 18 nt, artificial
  Chemically synthesized
gaggaaauagggaguugu

SEQ ID NO: 9103 - RNA, 18 nt, artificial
  Chemically synthesized
ccugaacccuaugaacuu

SEQ ID NO: 9104 - RNA, 18 nt, artificial
  Chemically synthesized
cccagcacuucauccaga

SEQ ID NO: 9105 - RNA, 18 nt, artificial
  Chemically synthesized
aguguuuguuacugagug

SEQ ID NO: 9106 - RNA, 18 nt, artificial
  Chemically synthesized
gcugaguuugaauaucac

SEQ ID NO: 9107 - RNA, 18 nt, artificial
  Chemically synthesized
augagugaguuuucagua

SEQ ID NO: 9108 - RNA, 18 nt, artificial
  Chemically synthesized
uguuguagcaguucuggu

SEQ ID NO: 9109 - RNA, 18 nt, artificial
  Chemically synthesized
gacucugaucccagccau

SEQ ID NO: 9110 - RNA, 18 nt, artificial
  Chemically synthesized
ggagugggaggacagugu

SEQ ID NO: 9111 - RNA, 18 nt, artificial
  Chemically synthesized
cuuuccagcaacaagauu

SEQ ID NO: 9112 - RNA, 18 nt, artificial
  Chemically synthesized
gagaaaacaaugugucug

SEQ ID NO: 9113 - RNA, 18 nt, artificial
  Chemically synthesized
uagcaucucuagagaacu

SEQ ID NO: 9114 - RNA, 18 nt, artificial
  Chemically synthesized
cagaaacagaacauucaa

SEQ ID NO: 9115 - RNA, 18 nt, artificial
  Chemically synthesized
cauuggacaucucaaaac

SEQ ID NO: 9116 - RNA, 18 nt, artificial
  Chemically synthesized
ugcuguuucuuuagccac

SEQ ID NO: 9117 - RNA, 18 nt, artificial
  Chemically synthesized
caaucuagagcacuugga

SEQ ID NO: 9118 - RNA, 18 nt, artificial
  Chemically synthesized
ccagccuccucagaaaca

SEQ ID NO: 9119 - RNA, 18 nt, artificial
  Chemically synthesized
cuuuagggagacacagau

SEQ ID NO: 9120 - RNA, 18 nt, artificial
  Chemically synthesized
cucuccugugacaaaaga

SEQ ID NO: 9121 - RNA, 18 nt, artificial
  Chemically synthesized
acuacagagacuuuauuc

SEQ ID NO: 9122 - RNA, 18 nt, artificial
  Chemically synthesized
cugguuuagaaguccauc

SEQ ID NO: 9123 - RNA, 18 nt, artificial
  Chemically synthesized
ugguggaaguugaacgaa

SEQ ID NO: 9124 - RNA, 18 nt, artificial
  Chemically synthesized
cagccuaaaguauuuaga

SEQ ID NO: 9125 - RNA, 18 nt, artificial
  Chemically synthesized
aaaucuagcaucucuaga

SEQ ID NO: 9126 - RNA, 18 nt, artificial
  Chemically synthesized
ggacuggguaaggaauga

SEQ ID NO: 9127 - RNA, 18 nt, artificial
  Chemically synthesized
aacucacucuccagucuu

SEQ ID NO: 9128 - RNA, 18 nt, artificial
  Chemically synthesized
ccagaguugcuuucaaug

SEQ ID NO: 9129 - RNA, 18 nt, artificial
  Chemically synthesized
agcugagaaacuugaccu

SEQ ID NO: 9130 - RNA, 18 nt, artificial
  Chemically synthesized
ugggaagaguggauguua

SEQ ID NO: 9131 - RNA, 18 nt, artificial
  Chemically synthesized
aguauacauugcuguuuc

SEQ ID NO: 9132 - RNA, 18 nt, artificial
  Chemically synthesized
ugguagaggugaaaacau

SEQ ID NO: 9133 - RNA, 18 nt, artificial
  Chemically synthesized
acaucauccaugaagguu

SEQ ID NO: 9134 - RNA, 18 nt, artificial
  Chemically synthesized
cuaaguaaugacugucau

SEQ ID NO: 9135 - RNA, 18 nt, artificial
  Chemically synthesized
cugcuaaucucaaggagc

SEQ ID NO: 9136 - RNA, 18 nt, artificial
  Chemically synthesized
ccauaaaagccgaaaggu

SEQ ID NO: 9137 - RNA, 18 nt, artificial
  Chemically synthesized
ugauggaccucugaaucu

SEQ ID NO: 9138 - RNA, 18 nt, artificial
  Chemically synthesized
gaccucugaaucucuuua

SEQ ID NO: 9139 - RNA, 18 nt, artificial
  Chemically synthesized
ugcuuucaauggcaucuu

SEQ ID NO: 9140 - RNA, 18 nt, artificial
  Chemically synthesized
cauuuaccuugacauuuc

SEQ ID NO: 9141 - RNA, 18 nt, artificial
  Chemically synthesized
ugaucuaccaagccuuga

SEQ ID NO: 9142 - RNA, 18 nt, artificial
  Chemically synthesized
cacagucagaaguguuug

SEQ ID NO: 9143 - RNA, 18 nt, artificial
  Chemically synthesized
uaaucugaccaaucuaga

SEQ ID NO: 9144 - RNA, 18 nt, artificial
  Chemically synthesized
caaaaaacaggaacuaca

SEQ ID NO: 9145 - RNA, 18 nt, artificial
  Chemically synthesized
cccacauugaaacucaaa

SEQ ID NO: 9146 - RNA, 18 nt, artificial
  Chemically synthesized
agaucucaguagaaaugg

SEQ ID NO: 9147 - RNA, 18 nt, artificial
  Chemically synthesized
uggacaauuugggcuaga

SEQ ID NO: 9148 - RNA, 18 nt, artificial
  Chemically synthesized
gcuccuugaccacauuuu

SEQ ID NO: 9149 - RNA, 18 nt, artificial
  Chemically synthesized
cacuagauaugcagggcu

SEQ ID NO: 9150 - RNA, 18 nt, artificial
  Chemically synthesized
guaaugacugucaugaaa

SEQ ID NO: 9151 - RNA, 18 nt, artificial
  Chemically synthesized
guuucuuuagccacuggu

SEQ ID NO: 9152 - RNA, 18 nt, artificial
  Chemically synthesized
gaaggaacaguggguaca

SEQ ID NO: 9153 - RNA, 18 nt, artificial
  Chemically synthesized
cuggucuauaaguucuau

SEQ ID NO: 9154 - RNA, 18 nt, artificial
  Chemically synthesized
aguaucuguuguagcagu

SEQ ID NO: 9155 - RNA, 18 nt, artificial
  Chemically synthesized
gcauacuuagacuacuac

SEQ ID NO: 9156 - RNA, 18 nt, artificial
  Chemically synthesized
gguaguuuugacugaacu

SEQ ID NO: 9157 - RNA, 18 nt, artificial
  Chemically synthesized
agggugaguaauuccaug

SEQ ID NO: 9158 - RNA, 18 nt, artificial
  Chemically synthesized
cuuaauguggcucacaau

SEQ ID NO: 9159 - RNA, 18 nt, artificial
  Chemically synthesized
ggucauucucgagcaugu

SEQ ID NO: 9160 - RNA, 18 nt, artificial
  Chemically synthesized
ccuauguaucccuaucag

SEQ ID NO: 9161 - RNA, 18 nt, artificial
  Chemically synthesized
agguugcuguucucaaag

SEQ ID NO: 9162 - RNA, 18 nt, artificial
  Chemically synthesized
cagucgugcugguaucau

SEQ ID NO: 9163 - RNA, 18 nt, artificial
  Chemically synthesized
gaguguuucagagugugu

SEQ ID NO: 9164 - RNA, 18 nt, artificial
  Chemically synthesized
uccagacaauugaagaug

SEQ ID NO: 9165 - RNA, 18 nt, artificial
  Chemically synthesized
gacuggguaaggaaugag

SEQ ID NO: 9166 - RNA, 18 nt, artificial
  Chemically synthesized
gcugcauaaaguauggua

SEQ ID NO: 9167 - RNA, 18 nt, artificial
  Chemically synthesized
acguuuccuuauaagugu

SEQ ID NO: 9168 - RNA, 18 nt, artificial
  Chemically synthesized
ggcaaugcuccuugacca

SEQ ID NO: 9169 - RNA, 18 nt, artificial
  Chemically synthesized
guccagaaugcuaagguu

SEQ ID NO: 9170 - RNA, 18 nt, artificial
  Chemically synthesized
cuuacucagaaugacuuu

SEQ ID NO: 9171 - RNA, 18 nt, artificial
  Chemically synthesized
ccagaaugcuaagguugc

SEQ ID NO: 9172 - RNA, 18 nt, artificial
  Chemically synthesized
agacauuguucuuuuccu

SEQ ID NO: 9173 - RNA, 18 nt, artificial
  Chemically synthesized
accugucccugaacccua

SEQ ID NO: 9174 - RNA, 18 nt, artificial
  Chemically synthesized
agaacaagugauguuuga

SEQ ID NO: 9175 - RNA, 18 nt, artificial
  Chemically synthesized
agguauucaaggcaggga

SEQ ID NO: 9176 - RNA, 18 nt, artificial
  Chemically synthesized
caauggcuuguccagucu

SEQ ID NO: 9177 - RNA, 18 nt, artificial
  Chemically synthesized
aagggagaaaugaggaaa

SEQ ID NO: 9178 - RNA, 18 nt, artificial
  Chemically synthesized
cggguucuacaucaaaug

SEQ ID NO: 9179 - RNA, 18 nt, artificial
  Chemically synthesized
gagcuucaaugguguuau

SEQ ID NO: 9180 - RNA, 18 nt, artificial
  Chemically synthesized
accagaguugcuuucaau

SEQ ID NO: 9181 - RNA, 18 nt, artificial
  Chemically synthesized
ggugcacuagauaugcag

SEQ ID NO: 9182 - RNA, 18 nt, artificial
  Chemically synthesized
uagccaucauaaaaccau

SEQ ID NO: 9183 - RNA, 18 nt, artificial
  Chemically synthesized
gagaaaugaggaaauagg

SEQ ID NO: 9184 - RNA, 18 nt, artificial
  Chemically synthesized
gaaugagcuaguaaagaa

SEQ ID NO: 9185 - RNA, 18 nt, artificial
  Chemically synthesized
cugaguguuucagagugu

SEQ ID NO: 9186 - RNA, 18 nt, artificial
  Chemically synthesized
gguagaggugaaaacauc

SEQ ID NO: 9187 - RNA, 18 nt, artificial
  Chemically synthesized
gaccaucauugguguguc

SEQ ID NO: 9188 - RNA, 18 nt, artificial
  Chemically synthesized
ggucugcaggcguuuucu

SEQ ID NO: 9189 - RNA, 18 nt, artificial
  Chemically synthesized
ugaguuucuagaucucag

SEQ ID NO: 9190 - RNA, 18 nt, artificial
  Chemically synthesized
agcaucucuagagaacuu

SEQ ID NO: 9191 - RNA, 18 nt, artificial
  Chemically synthesized
gugugucgguccucagug

SEQ ID NO: 9192 - RNA, 18 nt, artificial
  Chemically synthesized
gcuaaucucaaggagcuu

SEQ ID NO: 9193 - RNA, 18 nt, artificial
  Chemically synthesized
cuucuucuaacuuccucu

SEQ ID NO: 9194 - RNA, 18 nt, artificial
  Chemically synthesized
cuuugaauacaccaauug

SEQ ID NO: 9195 - RNA, 18 nt, artificial
  Chemically synthesized
gaacaguggguacaggau

SEQ ID NO: 9196 - RNA, 18 nt, artificial
  Chemically synthesized
caaggucuggcugguuua

SEQ ID NO: 9197 - RNA, 18 nt, artificial
  Chemically synthesized
cucauuuaccuugacauu

SEQ ID NO: 9198 - RNA, 18 nt, artificial
  Chemically synthesized
guucucuacucuugugcu

SEQ ID NO: 9199 - RNA, 18 nt, artificial
  Chemically synthesized
caaugguguuauuaccau

SEQ ID NO: 9200 - RNA, 18 nt, artificial
  Chemically synthesized
uguguuuccaugucucau

SEQ ID NO: 9201 - RNA, 18 nt, artificial
  Chemically synthesized
uucaaagguugcuguucu

SEQ ID NO: 9202 - RNA, 18 nt, artificial
  Chemically synthesized
uggucuuaucauggacaa

SEQ ID NO: 9203 - RNA, 18 nt, artificial
  Chemically synthesized
caucuucuggagacgacu

SEQ ID NO: 9204 - RNA, 18 nt, artificial
  Chemically synthesized
gguuugagcaggucuagg

SEQ ID NO: 9205 - RNA, 18 nt, artificial
  Chemically synthesized
aguugucaaaacuggaaa

SEQ ID NO: 9206 - RNA, 18 nt, artificial
  Chemically synthesized
ccuuuagcccagaacugc

SEQ ID NO: 9207 - RNA, 18 nt, artificial
  Chemically synthesized
gugaguuuucaguauucc

SEQ ID NO: 9208 - RNA, 18 nt, artificial
  Chemically synthesized
aucccuauguaucccuau

SEQ ID NO: 9209 - RNA, 18 nt, artificial
  Chemically synthesized
ccaggugggcauuucaac

SEQ ID NO: 9210 - RNA, 18 nt, artificial
  Chemically synthesized
gcuguucucaaagugauu

SEQ ID NO: 9211 - RNA, 18 nt, artificial
  Chemically synthesized
caguugucuccaacagca

SEQ ID NO: 9212 - RNA, 18 nt, artificial
  Chemically synthesized
ccaaguagucuagcuuuc

SEQ ID NO: 9213 - RNA, 18 nt, artificial
  Chemically synthesized
gaagaaaauuuccgcuuc

SEQ ID NO: 9214 - RNA, 18 nt, artificial
  Chemically synthesized
ccuccugaggcauuucuu

SEQ ID NO: 9215 - RNA, 18 nt, artificial
  Chemically synthesized
ccugcaauggaucaagga

SEQ ID NO: 9216 - RNA, 18 nt, artificial
  Chemically synthesized
uaccaugaguucaaacuu

SEQ ID NO: 9217 - RNA, 18 nt, artificial
  Chemically synthesized
ccgauuagcauacuuaga

SEQ ID NO: 9218 - RNA, 18 nt, artificial
  Chemically synthesized
gugggcauuucaaccaac

SEQ ID NO: 9219 - RNA, 18 nt, artificial
  Chemically synthesized
gaaacaaaugagugaguu

SEQ ID NO: 9220 - RNA, 18 nt, artificial
  Chemically synthesized
ggaccagaggcagcucuu

SEQ ID NO: 9221 - RNA, 18 nt, artificial
  Chemically synthesized
ugcacauaucccuaugua

SEQ ID NO: 9222 - RNA, 18 nt, artificial
  Chemically synthesized
cuuauaagugucugaacu

SEQ ID NO: 9223 - RNA, 18 nt, artificial
  Chemically synthesized
cucauguacuagugaaag

SEQ ID NO: 9224 - RNA, 18 nt, artificial
  Chemically synthesized
ugcuaagguugccgcuuu

SEQ ID NO: 9225 - RNA, 18 nt, artificial
  Chemically synthesized
ggagccuuuucuggacua

SEQ ID NO: 9226 - RNA, 18 nt, artificial
  Chemically synthesized
caggaagcaacaucuauc

SEQ ID NO: 9227 - RNA, 18 nt, artificial
  Chemically synthesized
uaauguggcucacaaucu

SEQ ID NO: 9228 - RNA, 18 nt, artificial
  Chemically synthesized
agcuguaccgccuucuca

SEQ ID NO: 9229 - RNA, 18 nt, artificial
  Chemically synthesized
gcauuucaaccaacucag

SEQ ID NO: 9230 - RNA, 18 nt, artificial
  Chemically synthesized
ccaugucucauguacuag

SEQ ID NO: 9231 - RNA, 18 nt, artificial
  Chemically synthesized
gcucacagaagcagugag

SEQ ID NO: 9232 - RNA, 18 nt, artificial
  Chemically synthesized
cauuuuccaaguagucua

SEQ ID NO: 9233 - RNA, 18 nt, artificial
  Chemically synthesized
agaagguggagaagaccc

SEQ ID NO: 9234 - RNA, 18 nt, artificial
  Chemically synthesized
ucagaacaagugauguuu

SEQ ID NO: 9235 - RNA, 18 nt, artificial
  Chemically synthesized
aguguuucagaguguguu

SEQ ID NO: 9236 - RNA, 18 nt, artificial
  Chemically synthesized
augaguugcagcagaagu

SEQ ID NO: 9237 - RNA, 18 nt, artificial
  Chemically synthesized
gcucacaaucuuauccaa

SEQ ID NO: 9238 - RNA, 18 nt, artificial
  Chemically synthesized
cccuuuagcccagaacug

SEQ ID NO: 9239 - RNA, 18 nt, artificial
  Chemically synthesized
ugaccauugaagaauucc

SEQ ID NO: 9240 - RNA, 18 nt, artificial
  Chemically synthesized
cacucugucacuuuguca

SEQ ID NO: 9241 - RNA, 18 nt, artificial
  Chemically synthesized
uggcuguuugagaugagu

SEQ ID NO: 9242 - RNA, 18 nt, artificial
  Chemically synthesized
guuguuuaagacgugcuu

SEQ ID NO: 9243 - RNA, 18 nt, artificial
  Chemically synthesized
cucuccugcgugagacca

SEQ ID NO: 9244 - RNA, 18 nt, artificial
  Chemically synthesized
agacuuuauucccggugu

SEQ ID NO: 9245 - RNA, 18 nt, artificial
  Chemically synthesized
cacaaucuuauccaaucu

SEQ ID NO: 9246 - RNA, 18 nt, artificial
  Chemically synthesized
aaaacuuccuuccagaua

SEQ ID NO: 9247 - RNA, 18 nt, artificial
  Chemically synthesized
caagaaaaggacaaucag

SEQ ID NO: 9248 - RNA, 18 nt, artificial
  Chemically synthesized
uaccaagccuugaguuuc

SEQ ID NO: 9249 - RNA, 18 nt, artificial
  Chemically synthesized
acucuuaccucaucaagu

SEQ ID NO: 9250 - RNA, 18 nt, artificial
  Chemically synthesized
guguuucagaguguguuu

SEQ ID NO: 9251 - RNA, 18 nt, artificial
  Chemically synthesized
ccagaaaagaauguucau

SEQ ID NO: 9252 - RNA, 18 nt, artificial
  Chemically synthesized
ggucaccuuuucuugauu

SEQ ID NO: 9253 - RNA, 18 nt, artificial
  Chemically synthesized
gcuggaugguaaaucaug

SEQ ID NO: 9254 - RNA, 18 nt, artificial
  Chemically synthesized
cagguucuugauuacagu

SEQ ID NO: 9255 - RNA, 18 nt, artificial
  Chemically synthesized
guuucaaagguugcuguu

SEQ ID NO: 9256 - RNA, 18 nt, artificial
  Chemically synthesized
cucucucagugucaacug

SEQ ID NO: 9257 - RNA, 18 nt, artificial
  Chemically synthesized
aacuacgugugaagguau

SEQ ID NO: 9258 - RNA, 18 nt, artificial
  Chemically synthesized
agaggugaaaacaucuau

SEQ ID NO: 9259 - RNA, 18 nt, artificial
  Chemically synthesized
acaaaucuagcaucucua

SEQ ID NO: 9260 - RNA, 18 nt, artificial
  Chemically synthesized
aagacgugcuucaaauau

SEQ ID NO: 9261 - RNA, 18 nt, artificial
  Chemically synthesized
ugccuucacuacagagac

SEQ ID NO: 9262 - RNA, 18 nt, artificial
  Chemically synthesized
aguggauguuaucauuga

SEQ ID NO: 9263 - RNA, 18 nt, artificial
  Chemically synthesized
ugaacuuuauccaaccag

SEQ ID NO: 9264 - RNA, 18 nt, artificial
  Chemically synthesized
agaaaacagaaagagaca

SEQ ID NO: 9265 - RNA, 18 nt, artificial
  Chemically synthesized
gcugagaaacuugaccuu

SEQ ID NO: 9266 - RNA, 18 nt, artificial
  Chemically synthesized
ugcucacagaagcaguga

SEQ ID NO: 9267 - RNA, 18 nt, artificial
  Chemically synthesized
uuugagaugaguucucua

SEQ ID NO: 9268 - RNA, 18 nt, artificial
  Chemically synthesized
agcacuucauccagagcc

SEQ ID NO: 9269 - RNA, 18 nt, artificial
  Chemically synthesized
aguggguacaggaugcaa

SEQ ID NO: 9270 - RNA, 18 nt, artificial
  Chemically synthesized
ccagacaauugaagaugg

SEQ ID NO: 9271 - RNA, 18 nt, artificial
  Chemically synthesized
gcgccuggcugggacucu

SEQ ID NO: 9272 - RNA, 18 nt, artificial
  Chemically synthesized
ucugggagaauuuagaaa

SEQ ID NO: 9273 - RNA, 18 nt, artificial
  Chemically synthesized
uggguaaggaaugagcua

SEQ ID NO: 9274 - RNA, 18 nt, artificial
  Chemically synthesized
gaaggaaacuuggaaaag

SEQ ID NO: 9275 - RNA, 18 nt, artificial
  Chemically synthesized
gagaagacaccagugccu

SEQ ID NO: 9276 - RNA, 18 nt, artificial
  Chemically synthesized
uauaauuucggauggcaa

SEQ ID NO: 9277 - RNA, 18 nt, artificial
  Chemically synthesized
aucuggauuuccagcauu

SEQ ID NO: 9278 - RNA, 18 nt, artificial
  Chemically synthesized
acccuuuagcccagaacu

SEQ ID NO: 9279 - RNA, 18 nt, artificial
  Chemically synthesized
acagaaagagacauuguu

SEQ ID NO: 9280 - RNA, 18 nt, artificial
  Chemically synthesized
gucuggcugguuuagaag

SEQ ID NO: 9281 - RNA, 18 nt, artificial
  Chemically synthesized
gagcaggucuagggugau

SEQ ID NO: 9282 - RNA, 18 nt, artificial
  Chemically synthesized
cuuccagugcagagggaa

SEQ ID NO: 9283 - RNA, 18 nt, artificial
  Chemically synthesized
cuuguacaguagucuccc

SEQ ID NO: 9284 - RNA, 18 nt, artificial
  Chemically synthesized
gccuaaaguauuuagauc

SEQ ID NO: 9285 - RNA, 18 nt, artificial
  Chemically synthesized
cuuucacuuccaacaaag

SEQ ID NO: 9286 - RNA, 18 nt, artificial
  Chemically synthesized
caaccaggugcauuuaaa

SEQ ID NO: 9287 - RNA, 18 nt, artificial
  Chemically synthesized
gcuggguccaacacuugu

SEQ ID NO: 9288 - RNA, 18 nt, artificial
  Chemically synthesized
gaucuaccaagccuugag

SEQ ID NO: 9289 - RNA, 18 nt, artificial
  Chemically synthesized
ccgaaaggugauuguugu

SEQ ID NO: 9290 - RNA, 18 nt, artificial
  Chemically synthesized
uggucauucucgagcaug

SEQ ID NO: 9291 - RNA, 18 nt, artificial
  Chemically synthesized
auuggauacguuuccuua

SEQ ID NO: 9292 - RNA, 18 nt, artificial
  Chemically synthesized
gauacguuuccuuauaag

SEQ ID NO: 9293 - RNA, 18 nt, artificial
  Chemically synthesized
ucacuacagagacuuuau

SEQ ID NO: 9294 - RNA, 18 nt, artificial
  Chemically synthesized
cucgaagucuugaaaaug

SEQ ID NO: 9295 - RNA, 18 nt, artificial
  Chemically synthesized
guucauccagccuccuca

SEQ ID NO: 9296 - RNA, 18 nt, artificial
  Chemically synthesized
gcaguuucugagcagucg

SEQ ID NO: 9297 - RNA, 18 nt, artificial
  Chemically synthesized
agcacuuggaccuuucca

SEQ ID NO: 9298 - RNA, 18 nt, artificial
  Chemically synthesized
caucuggauuuccagcau

SEQ ID NO: 9299 - RNA, 18 nt, artificial
  Chemically synthesized
gugcugguaucaucuuca

SEQ ID NO: 9300 - RNA, 18 nt, artificial
  Chemically synthesized
cuucaaugguguuauuac

SEQ ID NO: 9301 - RNA, 18 nt, artificial
  Chemically synthesized
gggaagaaaauuuccgcu

SEQ ID NO: 9302 - RNA, 18 nt, artificial
  Chemically synthesized
agcaggucuagggugauu

SEQ ID NO: 9303 - RNA, 18 nt, artificial
  Chemically synthesized
cuucacagagcugagaaa

SEQ ID NO: 9304 - RNA, 18 nt, artificial
  Chemically synthesized
cccuuccauuuuaagucu

SEQ ID NO: 9305 - RNA, 18 nt, artificial
  Chemically synthesized
ggaaaacuuccuuccaga

SEQ ID NO: 9306 - RNA, 18 nt, artificial
  Chemically synthesized
cauguacuagugaaagua

SEQ ID NO: 9307 - RNA, 18 nt, artificial
  Chemically synthesized
cgugugaagguauucaag

SEQ ID NO: 9308 - RNA, 18 nt, artificial
  Chemically synthesized
cgcuuucacuuccucuca

SEQ ID NO: 9309 - RNA, 18 nt, artificial
  Chemically synthesized
agaguguguuugguuuga

SEQ ID NO: 9310 - RNA, 18 nt, artificial
  Chemically synthesized
ugaguuugaauaucaccu

SEQ ID NO: 9311 - RNA, 18 nt, artificial
  Chemically synthesized
gaggaagggagaaaugag

SEQ ID NO: 9312 - RNA, 18 nt, artificial
  Chemically synthesized
cauuguucuuuuccugag

SEQ ID NO: 9313 - RNA, 18 nt, artificial
  Chemically synthesized
agccaucauaaaaccauu

SEQ ID NO: 9314 - RNA, 18 nt, artificial
  Chemically synthesized
caccuuuucuugauucca

SEQ ID NO: 9315 - RNA, 18 nt, artificial
  Chemically synthesized
guagaugugugcauuugu

SEQ ID NO: 9316 - RNA, 18 nt, artificial
  Chemically synthesized
caaaaggcuuacuuucac

SEQ ID NO: 9317 - RNA, 18 nt, artificial
  Chemically synthesized
caaugcuccuugaccaca

SEQ ID NO: 9318 - RNA, 18 nt, artificial
  Chemically synthesized
agcauacuuagacuacua

SEQ ID NO: 9319 - RNA, 18 nt, artificial
  Chemically synthesized
gggcaugccugugcugag

SEQ ID NO: 9320 - RNA, 18 nt, artificial
  Chemically synthesized
cauccuggucauucucga

SEQ ID NO: 9321 - RNA, 18 nt, artificial
  Chemically synthesized
gaaagagacauuguucuu

SEQ ID NO: 9322 - RNA, 18 nt, artificial
  Chemically synthesized
caacaaaggugggaaugc

SEQ ID NO: 9323 - RNA, 18 nt, artificial
  Chemically synthesized
cuuugaauaugagauugc

SEQ ID NO: 9324 - RNA, 18 nt, artificial
  Chemically synthesized
caucuucauuguccugca

SEQ ID NO: 9325 - RNA, 18 nt, artificial
  Chemically synthesized
gaacuggguguucacuuu

SEQ ID NO: 9326 - RNA, 18 nt, artificial
  Chemically synthesized
ugaggacuggguaaggaa

SEQ ID NO: 9327 - RNA, 18 nt, artificial
  Chemically synthesized
aagucuaguggcuaauuc

SEQ ID NO: 9328 - RNA, 18 nt, artificial
  Chemically synthesized
gggcuccugaugcaagau

SEQ ID NO: 9329 - RNA, 18 nt, artificial
  Chemically synthesized
ccacuggucugcaggcgu

SEQ ID NO: 9330 - RNA, 18 nt, artificial
  Chemically synthesized
gaaguauggaaaaguaca

SEQ ID NO: 9331 - RNA, 18 nt, artificial
  Chemically synthesized
guuuccuuauaagugucu

SEQ ID NO: 9332 - RNA, 18 nt, artificial
  Chemically synthesized
cagaaaagaauguucauc

SEQ ID NO: 9333 - RNA, 18 nt, artificial
  Chemically synthesized
gaaaccugauuaacacau

SEQ ID NO: 9334 - RNA, 18 nt, artificial
  Chemically synthesized
gaaaguagaugugugcau

SEQ ID NO: 9335 - RNA, 18 nt, artificial
  Chemically synthesized
uguucuuuuccugagucu

SEQ ID NO: 9336 - RNA, 18 nt, artificial
  Chemically synthesized
caugaguucaaacuucuu

SEQ ID NO: 9337 - RNA, 18 nt, artificial
  Chemically synthesized
cccuacucaaucucucuu

SEQ ID NO: 9338 - RNA, 18 nt, artificial
  Chemically synthesized
auuuccgcuuccuggucu

SEQ ID NO: 9339 - RNA, 18 nt, artificial
  Chemically synthesized
ugagugugacuauugaaa

SEQ ID NO: 9340 - RNA, 18 nt, artificial
  Chemically synthesized
gacacagauggcugggau

SEQ ID NO: 9341 - RNA, 18 nt, artificial
  Chemically synthesized
ugagaaaacaaugugucu

SEQ ID NO: 9342 - RNA, 18 nt, artificial
  Chemically synthesized
agagaagacaccagugcc

SEQ ID NO: 9343 - RNA, 18 nt, artificial
  Chemically synthesized
ggaugaggacuggguaag

SEQ ID NO: 9344 - RNA, 18 nt, artificial
  Chemically synthesized
auaugaccacagucagaa

SEQ ID NO: 9345 - RNA, 18 nt, artificial
  Chemically synthesized
cauacuuagacuacuacc

SEQ ID NO: 9346 - RNA, 18 nt, artificial
  Chemically synthesized
ccuuuucuggacuaucaa

SEQ ID NO: 9347 - RNA, 18 nt, artificial
  Chemically synthesized
cuacuaccucgaugauau

SEQ ID NO: 9348 - RNA, 18 nt, artificial
  Chemically synthesized
acaccagugccucagaaa

SEQ ID NO: 9349 - RNA, 18 nt, artificial
  Chemically synthesized
aucucucuuuagaccugu

SEQ ID NO: 9350 - RNA, 18 nt, artificial
  Chemically synthesized
gagccacaacaacuucuu

SEQ ID NO: 9351 - RNA, 18 nt, artificial
  Chemically synthesized
gugugcuuguaguaucug

SEQ ID NO: 9352 - RNA, 18 nt, artificial
  Chemically synthesized
acucaaucucucuuuaga

SEQ ID NO: 9353 - RNA, 18 nt, artificial
  Chemically synthesized
aucuguauagaagagagu

SEQ ID NO: 9354 - RNA, 18 nt, artificial
  Chemically synthesized
acucgaugucauuccaaa

SEQ ID NO: 9355 - RNA, 18 nt, artificial
  Chemically synthesized
aagagaagacaccagugc

SEQ ID NO: 9356 - RNA, 18 nt, artificial
  Chemically synthesized
ccugugcaauuugaccau

SEQ ID NO: 9357 - RNA, 18 nt, artificial
  Chemically synthesized
aaggaaaccugauuaaca

SEQ ID NO: 9358 - RNA, 18 nt, artificial
  Chemically synthesized
gcaacaccuucagauaag

SEQ ID NO: 9359 - RNA, 18 nt, artificial
  Chemically synthesized
gaucugagcuucaauggu

SEQ ID NO: 9360 - RNA, 18 nt, artificial
  Chemically synthesized
cucuccagucuucaggua

SEQ ID NO: 9361 - RNA, 18 nt, artificial
  Chemically synthesized
agugauguuugauggacc

SEQ ID NO: 9362 - RNA, 18 nt, artificial
  Chemically synthesized
cuuguaguaucuguugua

SEQ ID NO: 9363 - RNA, 18 nt, artificial
  Chemically synthesized
cugcaauggaucaaggac

SEQ ID NO: 9364 - RNA, 18 nt, artificial
  Chemically synthesized
gaauaagaccaucauugg

SEQ ID NO: 9365 - RNA, 18 nt, artificial
  Chemically synthesized
gaaagaacuuaauguggc

SEQ ID NO: 9366 - RNA, 18 nt, artificial
  Chemically synthesized
auuccuaucacucagaaa

SEQ ID NO: 9367 - RNA, 18 nt, artificial
  Chemically synthesized
auaagguuguuuaagacg

SEQ ID NO: 9368 - RNA, 18 nt, artificial
  Chemically synthesized
agaccagaaagcugggag

SEQ ID NO: 9369 - RNA, 18 nt, artificial
  Chemically synthesized
ccauuucagcucugccuu

SEQ ID NO: 9370 - RNA, 18 nt, artificial
  Chemically synthesized
caagugauguuugaugga

SEQ ID NO: 9371 - RNA, 18 nt, artificial
  Chemically synthesized
uccucuccugugacaaaa

SEQ ID NO: 9372 - RNA, 18 nt, artificial
  Chemically synthesized
cucacucuccagucuuca

SEQ ID NO: 9373 - RNA, 18 nt, artificial
  Chemically synthesized
gaaugugcaacaccuuca

SEQ ID NO: 9374 - RNA, 18 nt, artificial
  Chemically synthesized
uguuaucuacucaagcca

SEQ ID NO: 9375 - RNA, 18 nt, artificial
  Chemically synthesized
uccucagugugcuuguag

SEQ ID NO: 9376 - RNA, 18 nt, artificial
  Chemically synthesized
guccgcaugaucauaucu

SEQ ID NO: 9377 - RNA, 18 nt, artificial
  Chemically synthesized
cauggacaauuugggcua

SEQ ID NO: 9378 - RNA, 18 nt, artificial
  Chemically synthesized
uggcuguggagacaaauc

SEQ ID NO: 9379 - RNA, 18 nt, artificial
  Chemically synthesized
cugauuaacacaugcuca

SEQ ID NO: 9380 - RNA, 18 nt, artificial
  Chemically synthesized
aauccagacaauugaaga

SEQ ID NO: 9381 - RNA, 18 nt, artificial
  Chemically synthesized
ggguacaggaugcaauug

SEQ ID NO: 9382 - RNA, 18 nt, artificial
  Chemically synthesized
aguuucaaagguugcugu

SEQ ID NO: 9383 - RNA, 18 nt, artificial
  Chemically synthesized
ccagaaagcugggagccc

SEQ ID NO: 9384 - RNA, 18 nt, artificial
  Chemically synthesized
gccacaugucaggccuua

SEQ ID NO: 9385 - RNA, 18 nt, artificial
  Chemically synthesized
agucauuucaacucuuac

SEQ ID NO: 9386 - RNA, 18 nt, artificial
  Chemically synthesized
gucagaaguguuuguuac

SEQ ID NO: 9387 - RNA, 18 nt, artificial
  Chemically synthesized
gcuuucacuuccucucac

SEQ ID NO: 9388 - RNA, 18 nt, artificial
  Chemically synthesized
accucauuuaccuugaca

SEQ ID NO: 9389 - RNA, 18 nt, artificial
  Chemically synthesized
ccauccagaguuuagccc

SEQ ID NO: 9390 - RNA, 18 nt, artificial
  Chemically synthesized
ccacugcugcucacagaa

SEQ ID NO: 9391 - RNA, 18 nt, artificial
  Chemically synthesized
gaguuuagcccugggagc

SEQ ID NO: 9392 - RNA, 18 nt, artificial
  Chemically synthesized
gccaccucucuaccuuaa

SEQ ID NO: 9393 - RNA, 18 nt, artificial
  Chemically synthesized
augcuaagguugccgcuu

SEQ ID NO: 9394 - RNA, 18 nt, artificial
  Chemically synthesized
caugucucauguacuagu

SEQ ID NO: 9395 - RNA, 18 nt, artificial
  Chemically synthesized
accaugaguucaaacuuc

SEQ ID NO: 9396 - RNA, 18 nt, artificial
  Chemically synthesized
guguucacuuuuuccuuu

SEQ ID NO: 9397 - RNA, 18 nt, artificial
  Chemically synthesized
uaugcuaagggugaguaa

SEQ ID NO: 9398 - RNA, 18 nt, artificial
  Chemically synthesized
cuacucaaucucucuuua

SEQ ID NO: 9399 - RNA, 18 nt, artificial
  Chemically synthesized
agccacaacaacuucuuu

SEQ ID NO: 9400 - RNA, 18 nt, artificial
  Chemically synthesized
gaguaauuccauggugca

SEQ ID NO: 9401 - RNA, 18 nt, artificial
  Chemically synthesized
aagugauguuugauggac

SEQ ID NO: 9402 - RNA, 18 nt, artificial
  Chemically synthesized
cagagcugagaaacuuga

SEQ ID NO: 9403 - RNA, 18 nt, artificial
  Chemically synthesized
guuuagcccugggagccu

SEQ ID NO: 9404 - RNA, 18 nt, artificial
  Chemically synthesized
agggagacacagauggcu

SEQ ID NO: 9405 - RNA, 18 nt, artificial
  Chemically synthesized
augcagggcugcuaaucu

SEQ ID NO: 9406 - RNA, 18 nt, artificial
  Chemically synthesized
aaacaaaaguccagaaug

SEQ ID NO: 9407 - RNA, 18 nt, artificial
  Chemically synthesized
acucaaaucucucaaaag

SEQ ID NO: 9408 - RNA, 18 nt, artificial
  Chemically synthesized
aacagaaagagacauugu

SEQ ID NO: 9409 - RNA, 18 nt, artificial
  Chemically synthesized
uguacuagugaaaguaga

SEQ ID NO: 9410 - RNA, 18 nt, artificial
  Chemically synthesized
caucucuagagaacuucc

SEQ ID NO: 9411 - RNA, 18 nt, artificial
  Chemically synthesized
ccuggucauucucgagca

SEQ ID NO: 9412 - RNA, 18 nt, artificial
  Chemically synthesized
uaagggugaguaauucca

SEQ ID NO: 9413 - RNA, 18 nt, artificial
  Chemically synthesized
aaggcuuacuuucacuuc

SEQ ID NO: 9414 - RNA, 18 nt, artificial
  Chemically synthesized
cucgagcauguucuauuu

SEQ ID NO: 9415 - RNA, 18 nt, artificial
  Chemically synthesized
ugcuccuugaccacauuu

SEQ ID NO: 9416 - RNA, 18 nt, artificial
  Chemically synthesized
aauucuacuugaugacug

SEQ ID NO: 9417 - RNA, 18 nt, artificial
  Chemically synthesized
ccucucucagugucaacu

SEQ ID NO: 9418 - RNA, 18 nt, artificial
  Chemically synthesized
gucccugaacccuaugaa

SEQ ID NO: 9419 - RNA, 18 nt, artificial
  Chemically synthesized
cauuguccugcagaaggu

SEQ ID NO: 9420 - RNA, 18 nt, artificial
  Chemically synthesized
aggguaaaagacuuuucu

SEQ ID NO: 9421 - RNA, 18 nt, artificial
  Chemically synthesized
cacugcugcucacagaag

SEQ ID NO: 9422 - RNA, 18 nt, artificial
  Chemically synthesized
gaugucauuccaaaguua

SEQ ID NO: 9423 - RNA, 18 nt, artificial
  Chemically synthesized
cucagaaaccucauuuac

SEQ ID NO: 9424 - RNA, 18 nt, artificial
  Chemically synthesized
cuggguguguuuccaugu

SEQ ID NO: 9425 - RNA, 18 nt, artificial
  Chemically synthesized
gcaucuucaauggcuugu

SEQ ID NO: 9426 - RNA, 18 nt, artificial
  Chemically synthesized
augaaagcagcauugaaa

SEQ ID NO: 9427 - RNA, 18 nt, artificial
  Chemically synthesized
gauggaccucugaaucuc

SEQ ID NO: 9428 - RNA, 18 nt, artificial
  Chemically synthesized
aguugucuccaacagcau

SEQ ID NO: 9429 - RNA, 18 nt, artificial
  Chemically synthesized
agagccuaagccaccucu

SEQ ID NO: 9430 - RNA, 18 nt, artificial
  Chemically synthesized
cccuaucagggcugugug

SEQ ID NO: 9431 - RNA, 18 nt, artificial
  Chemically synthesized
guguguuuccaugucuca

SEQ ID NO: 9432 - RNA, 18 nt, artificial
  Chemically synthesized
ccagaguuuccugcaaug

SEQ ID NO: 9433 - RNA, 18 nt, artificial
  Chemically synthesized
aguuugaauaucaccugu

SEQ ID NO: 9434 - RNA, 18 nt, artificial
  Chemically synthesized
uuugguucugggagaauu

SEQ ID NO: 9435 - RNA, 18 nt, artificial
  Chemically synthesized
guugcagcagaaguuuau

SEQ ID NO: 9436 - RNA, 18 nt, artificial
  Chemically synthesized
guguuuccaugucucaug

SEQ ID NO: 9437 - RNA, 18 nt, artificial
  Chemically synthesized
caacuagaacaucuggau

SEQ ID NO: 9438 - RNA, 18 nt, artificial
  Chemically synthesized
uagggaguugucuaauug

SEQ ID NO: 9439 - RNA, 18 nt, artificial
  Chemically synthesized
cucagugugcuuguagua

SEQ ID NO: 9440 - RNA, 18 nt, artificial
  Chemically synthesized
cugucuccuuacagaggu

SEQ ID NO: 9441 - RNA, 18 nt, artificial
  Chemically synthesized
cuugugaacaccagaguu

SEQ ID NO: 9442 - RNA, 18 nt, artificial
  Chemically synthesized
cuuccaaaaaacaggaac

SEQ ID NO: 9443 - RNA, 18 nt, artificial
  Chemically synthesized
caacuggagcaguugucu

SEQ ID NO: 9444 - RNA, 18 nt, artificial
  Chemically synthesized
guuucuucauuuucccug

SEQ ID NO: 9445 - RNA, 18 nt, artificial
  Chemically synthesized
uguuugagaugaguucuc

SEQ ID NO: 9446 - RNA, 18 nt, artificial
  Chemically synthesized
accuuuccagcaacaaga

SEQ ID NO: 9447 - RNA, 18 nt, artificial
  Chemically synthesized
gccuacuaaguaaugacu

SEQ ID NO: 9448 - RNA, 18 nt, artificial
  Chemically synthesized
agaaaugaaggaaacuug

SEQ ID NO: 9449 - RNA, 18 nt, artificial
  Chemically synthesized
gcaugccugugcugaguu

SEQ ID NO: 9450 - RNA, 18 nt, artificial
  Chemically synthesized
ggaaugcuuuuucagaag

SEQ ID NO: 9451 - RNA, 18 nt, artificial
  Chemically synthesized
aacuagaacaucuggauu

SEQ ID NO: 9452 - RNA, 18 nt, artificial
  Chemically synthesized
ugcagcagaaguuuauuu

SEQ ID NO: 9453 - RNA, 18 nt, artificial
  Chemically synthesized
uacugaguguuucagagu

SEQ ID NO: 9454 - RNA, 18 nt, artificial
  Chemically synthesized
aaggcagggaguauacau

SEQ ID NO: 9455 - RNA, 18 nt, artificial
  Chemically synthesized
agcauuuaacucacucuc

SEQ ID NO: 9456 - RNA, 18 nt, artificial
  Chemically synthesized
gagccuuuucuggacuau

SEQ ID NO: 9457 - RNA, 18 nt, artificial
  Chemically synthesized
agugucaacuggagcagu

SEQ ID NO: 9458 - RNA, 18 nt, artificial
  Chemically synthesized
cacauaucccuauguauc

SEQ ID NO: 9459 - RNA, 18 nt, artificial
  Chemically synthesized
cuucauuguccugcagaa

SEQ ID NO: 9460 - RNA, 18 nt, artificial
  Chemically synthesized
auaugagauugcucagac

SEQ ID NO: 9461 - RNA, 18 nt, artificial
  Chemically synthesized
gcuuuuucagaaguugau

SEQ ID NO: 9462 - RNA, 18 nt, artificial
  Chemically synthesized
gaaauccagacaauugaa

SEQ ID NO: 9463 - RNA, 18 nt, artificial
  Chemically synthesized
cagauaucuucacagagc

SEQ ID NO: 9464 - RNA, 18 nt, artificial
  Chemically synthesized
gaaaggugauuguugugg

SEQ ID NO: 9465 - RNA, 18 nt, artificial
  Chemically synthesized
cuaugaugccuuuguuau

SEQ ID NO: 9466 - RNA, 18 nt, artificial
  Chemically synthesized
ccgccuucucagcaggaa

SEQ ID NO: 9467 - RNA, 18 nt, artificial
  Chemically synthesized
caccagugccucagaaac

SEQ ID NO: 9468 - RNA, 18 nt, artificial
  Chemically synthesized
acagacuugcggguucua

SEQ ID NO: 9469 - RNA, 18 nt, artificial
  Chemically synthesized
aaacuuguauucaagguc

SEQ ID NO: 9470 - RNA, 18 nt, artificial
  Chemically synthesized
cuaucugaagaggaaaaa

SEQ ID NO: 9471 - RNA, 18 nt, artificial
  Chemically synthesized
cagagccgcugguguauc

SEQ ID NO: 9472 - RNA, 18 nt, artificial
  Chemically synthesized
aguucaaacuucuugggc

SEQ ID NO: 9473 - RNA, 18 nt, artificial
  Chemically synthesized
gcccugggagccuuuucu

SEQ ID NO: 9474 - RNA, 18 nt, artificial
  Chemically synthesized
accaacucagucaaggaa

SEQ ID NO: 9475 - RNA, 18 nt, artificial
  Chemically synthesized
ggaggacaguguccuggg

SEQ ID NO: 9476 - RNA, 18 nt, artificial
  Chemically synthesized
accacagucagaaguguu

SEQ ID NO: 9477 - RNA, 18 nt, artificial
  Chemically synthesized
gaagcugguggcugugga

SEQ ID NO: 9478 - RNA, 18 nt, artificial
  Chemically synthesized
accuugacauuucucaua

SEQ ID NO: 9479 - RNA, 18 nt, artificial
  Chemically synthesized
ugcacagacuugcggguu

SEQ ID NO: 9480 - RNA, 18 nt, artificial
  Chemically synthesized
aaguguguguguccgcau

SEQ ID NO: 9481 - RNA, 18 nt, artificial
  Chemically synthesized
agucuaguggcuaauucc

SEQ ID NO: 9482 - RNA, 18 nt, artificial
  Chemically synthesized
cuuuguuaucuacucaag

SEQ ID NO: 9483 - RNA, 18 nt, artificial
  Chemically synthesized
gguuuagaaguccaucgu

SEQ ID NO: 9484 - RNA, 18 nt, artificial
  Chemically synthesized
accauugaagaauuccga

SEQ ID NO: 9485 - RNA, 18 nt, artificial
  Chemically synthesized
agggcaugccugugcuga

SEQ ID NO: 9486 - RNA, 18 nt, artificial
  Chemically synthesized
gugugacuauugaaaggg

SEQ ID NO: 9487 - RNA, 18 nt, artificial
  Chemically synthesized
cuggcugguuuagaaguc

SEQ ID NO: 9488 - RNA, 18 nt, artificial
  Chemically synthesized
aaggaaacuuggaaaagu

SEQ ID NO: 9489 - RNA, 18 nt, artificial
  Chemically synthesized
guccucagugugcuugua

SEQ ID NO: 9490 - RNA, 18 nt, artificial
  Chemically synthesized
aagcaacaucuaucugaa

SEQ ID NO: 9491 - RNA, 18 nt, artificial
  Chemically synthesized
guggaggugugaaaucca

SEQ ID NO: 9492 - RNA, 18 nt, artificial
  Chemically synthesized
cucaaaucucucaaaagg

SEQ ID NO: 9493 - RNA, 18 nt, artificial
  Chemically synthesized
uugugaacaccagaguuu

SEQ ID NO: 9494 - RNA, 18 nt, artificial
  Chemically synthesized
ugaccacagucagaagug

SEQ ID NO: 9495 - RNA, 18 nt, artificial
  Chemically synthesized
gaaugcuuuuucagaagu

SEQ ID NO: 9496 - RNA, 18 nt, artificial
  Chemically synthesized
cugcaggcguuuucuucu

SEQ ID NO: 9497 - RNA, 18 nt, artificial
  Chemically synthesized
uguuuguuacugaguguu

SEQ ID NO: 9498 - RNA, 18 nt, artificial
  Chemically synthesized
gaagcagugaggaugaug

SEQ ID NO: 9499 - RNA, 18 nt, artificial
  Chemically synthesized
ucgagcauguucuauuuu

SEQ ID NO: 9500 - RNA, 18 nt, artificial
  Chemically synthesized
ggugggaaugcuuuuuca

SEQ ID NO: 9501 - RNA, 18 nt, artificial
  Chemically synthesized
agguucccagaaaagaau

SEQ ID NO: 9502 - RNA, 18 nt, artificial
  Chemically synthesized
cauugcuguuuccuguug

SEQ ID NO: 9503 - RNA, 18 nt, artificial
  Chemically synthesized
gcguggaggugugaaauc

SEQ ID NO: 9504 - RNA, 18 nt, artificial
  Chemically synthesized
ccagagccgcugguguau

SEQ ID NO: 9505 - RNA, 18 nt, artificial
  Chemically synthesized
gaaaauuuccgcuuccug

SEQ ID NO: 9506 - RNA, 18 nt, artificial
  Chemically synthesized
gaacugcuuugaauacac

SEQ ID NO: 9507 - RNA, 18 nt, artificial
  Chemically synthesized
agucugucuccuuacaga

SEQ ID NO: 9508 - RNA, 18 nt, artificial
  Chemically synthesized
agggaguauacauugcug

SEQ ID NO: 9509 - RNA, 18 nt, artificial
  Chemically synthesized
uccagaaugcuaagguug

SEQ ID NO: 9510 - RNA, 18 nt, artificial
  Chemically synthesized
ccuggaccucucucagug

SEQ ID NO: 9511 - RNA, 18 nt, artificial
  Chemically synthesized
cuguuucuuuagccacug

SEQ ID NO: 9512 - RNA, 18 nt, artificial
  Chemically synthesized
gcuggcugcauaaaguau

SEQ ID NO: 9513 - RNA, 18 nt, artificial
  Chemically synthesized
gaaguugaacgaauggaa

SEQ ID NO: 9514 - RNA, 18 nt, artificial
  Chemically synthesized
ucuuuagggagacacaga

SEQ ID NO: 9515 - RNA, 18 nt, artificial
  Chemically synthesized
auuucggauggcaacauu

SEQ ID NO: 9516 - RNA, 18 nt, artificial
  Chemically synthesized
cuacuugaugacugcagu

SEQ ID NO: 9517 - RNA, 18 nt, artificial
  Chemically synthesized
guuaucuacucaagccag

SEQ ID NO: 9518 - RNA, 18 nt, artificial
  Chemically synthesized
uuccgauuagcauacuua

SEQ ID NO: 9519 - RNA, 18 nt, artificial
  Chemically synthesized
aguauuuagaucugagcu

SEQ ID NO: 9520 - RNA, 18 nt, artificial
  Chemically synthesized
gaagguuuccauaaaagc

SEQ ID NO: 9521 - RNA, 18 nt, artificial
  Chemically synthesized
ugcuuguacaguagucuc

SEQ ID NO: 9522 - RNA, 18 nt, artificial
  Chemically synthesized
ugaguuucaaagguugcu

SEQ ID NO: 9523 - RNA, 18 nt, artificial
  Chemically synthesized
gccaucauaaaaccauuu

SEQ ID NO: 9524 - RNA, 18 nt, artificial
  Chemically synthesized
acuugugaacaccagagu

SEQ ID NO: 9525 - RNA, 18 nt, artificial
  Chemically synthesized
caaaugagugaguuuuca

SEQ ID NO: 9526 - RNA, 18 nt, artificial
  Chemically synthesized
caaaucucucaaaaggcu

SEQ ID NO: 9527 - RNA, 18 nt, artificial
  Chemically synthesized
gagcagucgugcugguau

SEQ ID NO: 9528 - RNA, 18 nt, artificial
  Chemically synthesized
acucagucaaggaaccca

SEQ ID NO: 9529 - RNA, 18 nt, artificial
  Chemically synthesized
uagaaauggcuugaguuu

SEQ ID NO: 9530 - RNA, 18 nt, artificial
  Chemically synthesized
uuucuaaucugaccaauc

SEQ ID NO: 9531 - RNA, 18 nt, artificial
  Chemically synthesized
ucagaguguguuugguuu

SEQ ID NO: 9532 - RNA, 18 nt, artificial
  Chemically synthesized
uccgcaugaucauaucug

SEQ ID NO: 9533 - RNA, 18 nt, artificial
  Chemically synthesized
gagacgacucagaaaagc

SEQ ID NO: 9534 - RNA, 18 nt, artificial
  Chemically synthesized
cugaguuugaauaucacc

SEQ ID NO: 9535 - RNA, 18 nt, artificial
  Chemically synthesized
cucaaucacauaaugacu

SEQ ID NO: 9536 - RNA, 18 nt, artificial
  Chemically synthesized
gggaggacaguguccugg

SEQ ID NO: 9537 - RNA, 18 nt, artificial
  Chemically synthesized
cauuuugggaagagugga

SEQ ID NO: 9538 - RNA, 18 nt, artificial
  Chemically synthesized
ccaacaaaggugggaaug

SEQ ID NO: 9539 - RNA, 18 nt, artificial
  Chemically synthesized
cauuucaaccaacucagu

SEQ ID NO: 9540 - RNA, 18 nt, artificial
  Chemically synthesized
ugagaaacuugaccuucc

SEQ ID NO: 9541 - RNA, 18 nt, artificial
  Chemically synthesized
guuguagcaguucugguc

SEQ ID NO: 9542 - RNA, 18 nt, artificial
  Chemically synthesized
cagcuggguccaacacuu

SEQ ID NO: 9543 - RNA, 18 nt, artificial
  Chemically synthesized
ggaaaccugauuaacaca

SEQ ID NO: 9544 - RNA, 18 nt, artificial
  Chemically synthesized
ugucaugaaagcagcauu

SEQ ID NO: 9545 - RNA, 18 nt, artificial
  Chemically synthesized
ugcaauuugaccauugaa

SEQ ID NO: 9546 - RNA, 18 nt, artificial
  Chemically synthesized
ugaacccuaugaacuuua

SEQ ID NO: 9547 - RNA, 18 nt, artificial
  Chemically synthesized
gaaaagcccugcuggaug

SEQ ID NO: 9548 - RNA, 18 nt, artificial
  Chemically synthesized
gcuuguacaguagucucc

SEQ ID NO: 9549 - RNA, 18 nt, artificial
  Chemically synthesized
aaacaaugugucuggaau

SEQ ID NO: 9550 - RNA, 18 nt, artificial
  Chemically synthesized
auggcuugaguuucaaag

SEQ ID NO: 9551 - RNA, 18 nt, artificial
  Chemically synthesized
aguagaugugugcauuug

SEQ ID NO: 9552 - RNA, 18 nt, artificial
  Chemically synthesized
gagaaacuugaccuuccu

SEQ ID NO: 9553 - RNA, 18 nt, artificial
  Chemically synthesized
gguucccagaaaagaaug

SEQ ID NO: 9554 - RNA, 18 nt, artificial
  Chemically synthesized
ucuguauagaagagagug

SEQ ID NO: 9555 - RNA, 18 nt, artificial
  Chemically synthesized
cagccauggccuuccucu

SEQ ID NO: 9556 - RNA, 18 nt, artificial
  Chemically synthesized
auaagaccaucauuggug

SEQ ID NO: 9557 - RNA, 18 nt, artificial
  Chemically synthesized
augccuuuguuaucuacu

SEQ ID NO: 9558 - RNA, 18 nt, artificial
  Chemically synthesized
agcaguugucuccaacag

SEQ ID NO: 9559 - RNA, 18 nt, artificial
  Chemically synthesized
ucuggacuaucaaguuua

SEQ ID NO: 9560 - RNA, 18 nt, artificial
  Chemically synthesized
gaagaguggauguuauca

SEQ ID NO: 9561 - RNA, 18 nt, artificial
  Chemically synthesized
gaaaagaauguucaucca

SEQ ID NO: 9562 - RNA, 18 nt, artificial
  Chemically synthesized
gagccuaagccaccucuc

SEQ ID NO: 9563 - RNA, 18 nt, artificial
  Chemically synthesized
gaauggaaugugcaacac

SEQ ID NO: 9564 - RNA, 18 nt, artificial
  Chemically synthesized
gaacaucccugggugugu

SEQ ID NO: 9565 - RNA, 18 nt, artificial
  Chemically synthesized
cuuuagcccagaacugcu

SEQ ID NO: 9566 - RNA, 18 nt, artificial
  Chemically synthesized
caacacuuguucaguuaa

SEQ ID NO: 9567 - RNA, 18 nt, artificial
  Chemically synthesized
gaaggaagugggaugacc

SEQ ID NO: 9568 - RNA, 18 nt, artificial
  Chemically synthesized
gaaaauggcuggcaauuc

SEQ ID NO: 9569 - RNA, 18 nt, artificial
  Chemically synthesized
ccacaugucaggccuuau

SEQ ID NO: 9570 - RNA, 18 nt, artificial
  Chemically synthesized
uucggauggcaacauuua

SEQ ID NO: 9571 - RNA, 18 nt, artificial
  Chemically synthesized
agugaguuuucaguauuc

SEQ ID NO: 9572 - RNA, 18 nt, artificial
  Chemically synthesized
gagcugagaaacuugacc

SEQ ID NO: 9573 - RNA, 18 nt, artificial
  Chemically synthesized
aagguucccagaaaagaa

SEQ ID NO: 9574 - RNA, 18 nt, artificial
  Chemically synthesized
aagguugcuguucucaaa

SEQ ID NO: 9575 - RNA, 18 nt, artificial
  Chemically synthesized
gguggagcuguaccgccu

SEQ ID NO: 9576 - RNA, 18 nt, artificial
  Chemically synthesized
auucaguugucaaaacug

SEQ ID NO: 9577 - RNA, 18 nt, artificial
  Chemically synthesized
uccaggugggcauuucaa

SEQ ID NO: 9578 - RNA, 18 nt, artificial
  Chemically synthesized
ugagauugcucagaccug

SEQ ID NO: 9579 - RNA, 18 nt, artificial
  Chemically synthesized
aaaggaggaagggagaaa

SEQ ID NO: 9580 - RNA, 18 nt, artificial
  Chemically synthesized
caacagcauuuaacucac

SEQ ID NO: 9581 - RNA, 18 nt, artificial
  Chemically synthesized
ugaagguauucaaggcag

SEQ ID NO: 9582 - RNA, 18 nt, artificial
  Chemically synthesized
cuauguaucccuaucagg

SEQ ID NO: 9583 - RNA, 18 nt, artificial
  Chemically synthesized
ggcaugccugugcugagu

SEQ ID NO: 9584 - RNA, 18 nt, artificial
  Chemically synthesized
gaccuggcaguuucugag

SEQ ID NO: 9585 - RNA, 18 nt, artificial
  Chemically synthesized
cuggcaguuucugagcag

SEQ ID NO: 9586 - RNA, 18 nt, artificial
  Chemically synthesized
cuccaacagcauuuaacu

SEQ ID NO: 9587 - RNA, 18 nt, artificial
  Chemically synthesized
agaaaagcccugcuggau

SEQ ID NO: 9588 - RNA, 18 nt, artificial
  Chemically synthesized
aguugcuuucaauggcau

SEQ ID NO: 9589 - RNA, 18 nt, artificial
  Chemically synthesized
ugcuuuuucagaaguuga

SEQ ID NO: 9590 - RNA, 18 nt, artificial
  Chemically synthesized
ugcauaaaguaugguaga

SEQ ID NO: 9591 - RNA, 18 nt, artificial
  Chemically synthesized
aggaaguauggaaaagua

SEQ ID NO: 9592 - RNA, 18 nt, artificial
  Chemically synthesized
cacauuuugggaagagug

SEQ ID NO: 9593 - RNA, 18 nt, artificial
  Chemically synthesized
caacucuuaccucaucaa

SEQ ID NO: 9594 - RNA, 18 nt, artificial
  Chemically synthesized
aauggaucaaggaccaga

SEQ ID NO: 9595 - RNA, 18 nt, artificial
  Chemically synthesized
gggccugugcaauuugac

SEQ ID NO: 9596 - RNA, 18 nt, artificial
  Chemically synthesized
ugugaacaccagaguuuc

SEQ ID NO: 9597 - RNA, 18 nt, artificial
  Chemically synthesized
gugagaccagaaagcugg

SEQ ID NO: 9598 - RNA, 18 nt, artificial
  Chemically synthesized
ugacugucaugaaagcag

SEQ ID NO: 9599 - RNA, 18 nt, artificial
  Chemically synthesized
aaauaugagccacaacaa

SEQ ID NO: 9600 - RNA, 18 nt, artificial
  Chemically synthesized
cgguccucagugugcuug

SEQ ID NO: 9601 - RNA, 18 nt, artificial
  Chemically synthesized
ucucaguagaaauggcuu

SEQ ID NO: 9602 - RNA, 18 nt, artificial
  Chemically synthesized
gcuguguguauuugaaag

SEQ ID NO: 9603 - RNA, 18 nt, artificial
  Chemically synthesized
cuccucagaaacagaaca

SEQ ID NO: 9604 - RNA, 18 nt, artificial
  Chemically synthesized
cuguuguagcaguucugg

SEQ ID NO: 9605 - RNA, 18 nt, artificial
  Chemically synthesized
gagaacuacgugugaagg

SEQ ID NO: 9606 - RNA, 18 nt, artificial
  Chemically synthesized
uuucaguauuccuaucac

SEQ ID NO: 9607 - RNA, 18 nt, artificial
  Chemically synthesized
ugaugccuuuguuaucua

SEQ ID NO: 9608 - RNA, 18 nt, artificial
  Chemically synthesized
ccuaucacucagaaaccu

SEQ ID NO: 9609 - RNA, 18 nt, artificial
  Chemically synthesized
uggcuugaguuucaaagg

SEQ ID NO: 9610 - RNA, 18 nt, artificial
  Chemically synthesized
cuacuaaguaaugacugu

SEQ ID NO: 9611 - RNA, 18 nt, artificial
  Chemically synthesized
agaauguucauccagccu

SEQ ID NO: 9612 - RNA, 18 nt, artificial
  Chemically synthesized
gaauacaccaauugcugu

SEQ ID NO: 9613 - RNA, 18 nt, artificial
  Chemically synthesized
cagcauuuuccaaguagu

SEQ ID NO: 9614 - RNA, 18 nt, artificial
  Chemically synthesized
cagaaagcugggagcccu

SEQ ID NO: 9615 - RNA, 18 nt, artificial
  Chemically synthesized
gguugccgcuuucacuuc

SEQ ID NO: 9616 - RNA, 18 nt, artificial
  Chemically synthesized
acagcauuuuccaaguag

SEQ ID NO: 9617 - RNA, 18 nt, artificial
  Chemically synthesized
uugcuguucucaaaguga

SEQ ID NO: 9618 - RNA, 18 nt, artificial
  Chemically synthesized
cuguguguauuugaaagu

SEQ ID NO: 9619 - RNA, 18 nt, artificial
  Chemically synthesized
cucucuuuagaccugucc

SEQ ID NO: 9620 - RNA, 18 nt, artificial
  Chemically synthesized
uuuaagacgugcuucaaa

SEQ ID NO: 9621 - RNA, 18 nt, artificial
  Chemically synthesized
gagaccagaaagcuggga

SEQ ID NO: 9622 - RNA, 18 nt, artificial
  Chemically synthesized
uauucaaggcagggagua

SEQ ID NO: 9623 - RNA, 18 nt, artificial
  Chemically synthesized
aggagcuuccagugcaga

SEQ ID NO: 9624 - RNA, 18 nt, artificial
  Chemically synthesized
acaacuagaacaucugga

SEQ ID NO: 9625 - RNA, 18 nt, artificial
  Chemically synthesized
cuucagauaagcagggca

SEQ ID NO: 9626 - RNA, 18 nt, artificial
  Chemically synthesized
aaggaaugagcuaguaaa

SEQ ID NO: 9627 - RNA, 18 nt, artificial
  Chemically synthesized
cguuuucuucuucuaacu

SEQ ID NO: 9628 - RNA, 18 nt, artificial
  Chemically synthesized
ucuucuucuaacuuccuc

SEQ ID NO: 9629 - RNA, 18 nt, artificial
  Chemically synthesized
cauuucucauacucacac

SEQ ID NO: 9630 - RNA, 18 nt, artificial
  Chemically synthesized
accugaugcuucuugcug

SEQ ID NO: 9631 - RNA, 18 nt, artificial
  Chemically synthesized
acuaaauaugagccacaa

SEQ ID NO: 9632 - RNA, 18 nt, artificial
  Chemically synthesized
uacguuuccuuauaagug

SEQ ID NO: 9633 - RNA, 18 nt, artificial
  Chemically synthesized
guauucaaggucuggcug

SEQ ID NO: 9634 - RNA, 18 nt, artificial
  Chemically synthesized
cgcuuccuggucuuauca

SEQ ID NO: 9635 - RNA, 18 nt, artificial
  Chemically synthesized
ugaauaugagauugcuca

SEQ ID NO: 9636 - RNA, 18 nt, artificial
  Chemically synthesized
acugaguguuucagagug

SEQ ID NO: 9637 - RNA, 18 nt, artificial
  Chemically synthesized
gagugggaggacaguguc

SEQ ID NO: 9638 - RNA, 18 nt, artificial
  Chemically synthesized
cuuccuggucuuaucaug

SEQ ID NO: 9639 - RNA, 18 nt, artificial
  Chemically synthesized
ucaaaaggcuuacuuuca

SEQ ID NO: 9640 - RNA, 18 nt, artificial
  Chemically synthesized
uaucuguuguagcaguuc

SEQ ID NO: 9641 - RNA, 18 nt, artificial
  Chemically synthesized
auaucagagccuaagcca

SEQ ID NO: 9642 - RNA, 18 nt, artificial
  Chemically synthesized
acuguaaauuuggacagu

SEQ ID NO: 9643 - RNA, 18 nt, artificial
  Chemically synthesized
gauuuccagcauuccaau

SEQ ID NO: 9644 - RNA, 18 nt, artificial
  Chemically synthesized
agaaaaggacaaucagga

SEQ ID NO: 9645 - RNA, 18 nt, artificial
  Chemically synthesized
ucuauggcuguuugagau

SEQ ID NO: 9646 - RNA, 18 nt, artificial
  Chemically synthesized
aaaagaauguucauccag

SEQ ID NO: 9647 - RNA, 18 nt, artificial
  Chemically synthesized
uucacuuccaacaaaggu

SEQ ID NO: 9648 - RNA, 18 nt, artificial
  Chemically synthesized
cagaagcagugaggauga

SEQ ID NO: 9649 - RNA, 18 nt, artificial
  Chemically synthesized
ccuguacccuucucacug

SEQ ID NO: 9650 - RNA, 18 nt, artificial
  Chemically synthesized
cuagagcacuuggaccuu

SEQ ID NO: 9651 - RNA, 18 nt, artificial
  Chemically synthesized
gaaaugaggaaauaggga

SEQ ID NO: 9652 - RNA, 18 nt, artificial
  Chemically synthesized
ucacaaccauccugguca

SEQ ID NO: 9653 - RNA, 18 nt, artificial
  Chemically synthesized
aaacaucuaugaugccuu

SEQ ID NO: 9654 - RNA, 18 nt, artificial
  Chemically synthesized
gugauuuugggacaacca

SEQ ID NO: 9655 - RNA, 18 nt, artificial
  Chemically synthesized
cagcaacaagauucaaag

SEQ ID NO: 9656 - RNA, 18 nt, artificial
  Chemically synthesized
uucuuuagccacuggucu

SEQ ID NO: 9657 - RNA, 18 nt, artificial
  Chemically synthesized
ggcaggaaggaaguggga

SEQ ID NO: 9658 - RNA, 18 nt, artificial
  Chemically synthesized
guguuuguuacugagugu

SEQ ID NO: 9659 - RNA, 18 nt, artificial
  Chemically synthesized
ucucuacucuugugcuug

SEQ ID NO: 9660 - RNA, 18 nt, artificial
  Chemically synthesized
agaaagucauuucaacuc

SEQ ID NO: 9661 - RNA, 18 nt, artificial
  Chemically synthesized
aaguguuuguuacugagu

SEQ ID NO: 9662 - RNA, 18 nt, artificial
  Chemically synthesized
agacuacuaccucgauga

SEQ ID NO: 9663 - RNA, 18 nt, artificial
  Chemically synthesized
aagaguggauguuaucau

SEQ ID NO: 9664 - RNA, 18 nt, artificial
  Chemically synthesized
gugggaggacaguguccu

SEQ ID NO: 9665 - RNA, 18 nt, artificial
  Chemically synthesized
cugggagccuuuucugga

SEQ ID NO: 9666 - RNA, 18 nt, artificial
  Chemically synthesized
gugucaacuggagcaguu

SEQ ID NO: 9667 - RNA, 18 nt, artificial
  Chemically synthesized
ugggcauuucaaccaacu

SEQ ID NO: 9668 - RNA, 18 nt, artificial
  Chemically synthesized
caaaucugcucuagaggg

SEQ ID NO: 9669 - RNA, 18 nt, artificial
  Chemically synthesized
ucuggucuauaaguucua

SEQ ID NO: 9670 - RNA, 18 nt, artificial
  Chemically synthesized
auuucaacucuuaccuca

SEQ ID NO: 9671 - RNA, 18 nt, artificial
  Chemically synthesized
gucuccaacagcauuuaa

SEQ ID NO: 9672 - RNA, 18 nt, artificial
  Chemically synthesized
aagaagguucccagaaaa

SEQ ID NO: 9673 - RNA, 18 nt, artificial
  Chemically synthesized
cauccauuugaaauggau

SEQ ID NO: 9674 - RNA, 18 nt, artificial
  Chemically synthesized
uggaaauaugaccacagu

SEQ ID NO: 9675 - RNA, 18 nt, artificial
  Chemically synthesized
ugagccacaacaacuucu

SEQ ID NO: 9676 - RNA, 18 nt, artificial
  Chemically synthesized
cuguuuccuguugggcaa

SEQ ID NO: 9677 - RNA, 18 nt, artificial
  Chemically synthesized
cugaccaaucuagagcac

SEQ ID NO: 9678 - RNA, 18 nt, artificial
  Chemically synthesized
uggguguguuuccauguc

SEQ ID NO: 9679 - RNA, 18 nt, artificial
  Chemically synthesized
aacaggaacuacagcauu

SEQ ID NO: 9680 - RNA, 18 nt, artificial
  Chemically synthesized
cuugcuggcugcauaaag

SEQ ID NO: 9681 - RNA, 18 nt, artificial
  Chemically synthesized
aucuacucaagccaggau

SEQ ID NO: 9682 - RNA, 18 nt, artificial
  Chemically synthesized
guuucagaguguguuugg

SEQ ID NO: 9683 - RNA, 18 nt, artificial
  Chemically synthesized
cagugaggaugaugccag

SEQ ID NO: 9684 - RNA, 18 nt, artificial
  Chemically synthesized
acucagaaaccucauuua

SEQ ID NO: 9685 - RNA, 18 nt, artificial
  Chemically synthesized
aguucucuacucuugugc

SEQ ID NO: 9686 - RNA, 18 nt, artificial
  Chemically synthesized
gauagcgagccacgcauu

SEQ ID NO: 9687 - RNA, 18 nt, artificial
  Chemically synthesized
gacaauuugggcuagagg

SEQ ID NO: 9688 - RNA, 18 nt, artificial
  Chemically synthesized
uccugagucuuuugaaug

SEQ ID NO: 9689 - RNA, 18 nt, artificial
  Chemically synthesized
uuucaaagguugcuguuc

SEQ ID NO: 9690 - RNA, 18 nt, artificial
  Chemically synthesized
uacucuugugcuuguaca

SEQ ID NO: 9691 - RNA, 18 nt, artificial
  Chemically synthesized
guugucuccaacagcauu

SEQ ID NO: 9692 - RNA, 18 nt, artificial
  Chemically synthesized
uuccaaguagucuagcuu

SEQ ID NO: 9693 - RNA, 18 nt, artificial
  Chemically synthesized
ccaggaugaugucugccu

SEQ ID NO: 9694 - RNA, 18 nt, artificial
  Chemically synthesized
aacaagugauguuugaug

SEQ ID NO: 9695 - RNA, 18 nt, artificial
  Chemically synthesized
ucuccagucuucagguac

SEQ ID NO: 9696 - RNA, 18 nt, artificial
  Chemically synthesized
auacauugcuguuuccug

SEQ ID NO: 9697 - RNA, 18 nt, artificial
  Chemically synthesized
gaaaggguaaaagacuuu

SEQ ID NO: 9698 - RNA, 18 nt, artificial
  Chemically synthesized
ugcuuguaguaucuguug

SEQ ID NO: 9699 - RNA, 18 nt, artificial
  Chemically synthesized
acauuguucuuuuccuga

SEQ ID NO: 9700 - RNA, 18 nt, artificial
  Chemically synthesized
cauuuucccuggugagug

SEQ ID NO: 9701 - RNA, 18 nt, artificial
  Chemically synthesized
caaguuuacagaagcugg

SEQ ID NO: 9702 - RNA, 18 nt, artificial
  Chemically synthesized
agguuguuuaagacgugc

SEQ ID NO: 9703 - RNA, 18 nt, artificial
  Chemically synthesized
gacaaccagccuaaagua

SEQ ID NO: 9704 - RNA, 18 nt, artificial
  Chemically synthesized
gcagggaguauacauugc

SEQ ID NO: 9705 - RNA, 18 nt, artificial
  Chemically synthesized
ucagaugaauaagaccau

SEQ ID NO: 9706 - RNA, 18 nt, artificial
  Chemically synthesized
aucuaccaagccuugagu

SEQ ID NO: 9707 - RNA, 18 nt, artificial
  Chemically synthesized
aaauggaugucuauggcu

SEQ ID NO: 9708 - RNA, 18 nt, artificial
  Chemically synthesized
uacagagacuuuauuccc

SEQ ID NO: 9709 - RNA, 18 nt, artificial
  Chemically synthesized
acuggguguucacuuuuu

SEQ ID NO: 9710 - RNA, 18 nt, artificial
  Chemically synthesized
gguccaacacuuguucag

SEQ ID NO: 9711 - RNA, 18 nt, artificial
  Chemically synthesized
cagagggaauaaaugcua

SEQ ID NO: 9712 - RNA, 18 nt, artificial
  Chemically synthesized
ugaggaugaugccaggau

SEQ ID NO: 9713 - RNA, 18 nt, artificial
  Chemically synthesized
ccuaagccaccucucuac

SEQ ID NO: 9714 - RNA, 18 nt, artificial
  Chemically synthesized
augaguucaaacuucuug

SEQ ID NO: 9715 - RNA, 18 nt, artificial
  Chemically synthesized
gagggaauaaaugcuaga

SEQ ID NO: 9716 - RNA, 18 nt, artificial
  Chemically synthesized
auggcaucuucaauggcu

SEQ ID NO: 9717 - RNA, 18 nt, artificial
  Chemically synthesized
gucgguccucagugugcu

SEQ ID NO: 9718 - RNA, 18 nt, artificial
  Chemically synthesized
gcagcagguggagcugua

SEQ ID NO: 9719 - RNA, 18 nt, artificial
  Chemically synthesized
aacacaugcucacaacca

SEQ ID NO: 9720 - RNA, 18 nt, artificial
  Chemically synthesized
auuaacacaugcucacaa

SEQ ID NO: 9721 - RNA, 18 nt, artificial
  Chemically synthesized
ugcaacaccuucagauaa

SEQ ID NO: 9722 - RNA, 18 nt, artificial
  Chemically synthesized
auaucuucacagagcuga

SEQ ID NO: 9723 - RNA, 18 nt, artificial
  Chemically synthesized
uacagaagcugguggcug

SEQ ID NO: 9724 - RNA, 18 nt, artificial
  Chemically synthesized
cuggaaauaugaccacag

SEQ ID NO: 9725 - RNA, 18 nt, artificial
  Chemically synthesized
cccuguacccuucucacu

SEQ ID NO: 9726 - RNA, 18 nt, artificial
  Chemically synthesized
uggaccucugaaucucuu

SEQ ID NO: 9727 - RNA, 18 nt, artificial
  Chemically synthesized
uauccaaccaggugcauu

SEQ ID NO: 9728 - RNA, 18 nt, artificial
  Chemically synthesized
accaaucuagagcacuug

SEQ ID NO: 9729 - RNA, 18 nt, artificial
  Chemically synthesized
augagauugcucagaccu

SEQ ID NO: 9730 - RNA, 18 nt, artificial
  Chemically synthesized
gcuccugaugcaagaugc

SEQ ID NO: 9731 - RNA, 18 nt, artificial
  Chemically synthesized
guaucuguuguagcaguu

SEQ ID NO: 9732 - RNA, 18 nt, artificial
  Chemically synthesized
cucugucacuuugucacu

SEQ ID NO: 9733 - RNA, 18 nt, artificial
  Chemically synthesized
aauuucggauggcaacau

SEQ ID NO: 9734 - RNA, 18 nt, artificial
  Chemically synthesized
cuagaacaucuggauuuc

SEQ ID NO: 9735 - RNA, 18 nt, artificial
  Chemically synthesized
uacuuagacuacuaccuc

SEQ ID NO: 9736 - RNA, 18 nt, artificial
  Chemically synthesized
aaaggugauuguuguggu

SEQ ID NO: 9737 - RNA, 18 nt, artificial
  Chemically synthesized
caugacaaagaaagucau

SEQ ID NO: 9738 - RNA, 18 nt, artificial
  Chemically synthesized
gcuguaccgccuucucag

SEQ ID NO: 9739 - RNA, 18 nt, artificial
  Chemically synthesized
cauacucacaccagaguu

SEQ ID NO: 9740 - RNA, 18 nt, artificial
  Chemically synthesized
cuaaggaaaccugauuaa

SEQ ID NO: 9741 - RNA, 18 nt, artificial
  Chemically synthesized
cuuagacuacuaccucga

SEQ ID NO: 9742 - RNA, 18 nt, artificial
  Chemically synthesized
cagaaaagcccugcugga

SEQ ID NO: 9743 - RNA, 18 nt, artificial
  Chemically synthesized
ugugcauuugugcacaua

SEQ ID NO: 9744 - RNA, 18 nt, artificial
  Chemically synthesized
uccuuauaagugucugaa

SEQ ID NO: 9745 - RNA, 18 nt, artificial
  Chemically synthesized
uccagguucuugauuaca

SEQ ID NO: 9746 - RNA, 18 nt, artificial
  Chemically synthesized
aaacuuccuuccagauau

SEQ ID NO: 9747 - RNA, 18 nt, artificial
  Chemically synthesized
acaucuggauuuccagca

SEQ ID NO: 9748 - RNA, 18 nt, artificial
  Chemically synthesized
agucuuccaggugggcau

SEQ ID NO: 9749 - RNA, 18 nt, artificial
  Chemically synthesized
gucaacuggagcaguugu

SEQ ID NO: 9750 - RNA, 18 nt, artificial
  Chemically synthesized
cguuugguucugggagaa

SEQ ID NO: 9751 - RNA, 18 nt, artificial
  Chemically synthesized
cuggaccucucucagugu

SEQ ID NO: 9752 - RNA, 18 nt, artificial
  Chemically synthesized
ggaugaugucugccucgc

SEQ ID NO: 9753 - RNA, 18 nt, artificial
  Chemically synthesized
ccuggguguguuuccaug

SEQ ID NO: 9754 - RNA, 18 nt, artificial
  Chemically synthesized
ucagaaugacuuugcuug

SEQ ID NO: 9755 - RNA, 18 nt, artificial
  Chemically synthesized
cuugacauuucucauacu

SEQ ID NO: 9756 - RNA, 18 nt, artificial
  Chemically synthesized
caugccugugcugaguuu

SEQ ID NO: 9757 - RNA, 18 nt, artificial
  Chemically synthesized
gcuggcaauucuuuccag

SEQ ID NO: 9758 - RNA, 18 nt, artificial
  Chemically synthesized
gauaugcagggcugcuaa

SEQ ID NO: 9759 - RNA, 18 nt, artificial
  Chemically synthesized
ucugaccaaucuagagca

SEQ ID NO: 9760 - RNA, 18 nt, artificial
  Chemically synthesized
gaacaacuagaacaucug

SEQ ID NO: 9761 - RNA, 18 nt, artificial
  Chemically synthesized
aauggcuugaguuucaaa

SEQ ID NO: 9762 - RNA, 18 nt, artificial
  Chemically synthesized
aucuuacucagaaugacu

SEQ ID NO: 9763 - RNA, 18 nt, artificial
  Chemically synthesized
guaguaucuguuguagca

SEQ ID NO: 9764 - RNA, 18 nt, artificial
  Chemically synthesized
gugcuuguaguaucuguu

SEQ ID NO: 9765 - RNA, 18 nt, artificial
  Chemically synthesized
agauaucuucacagagcu

SEQ ID NO: 9766 - RNA, 18 nt, artificial
  Chemically synthesized
ucuucaauggcuugucca

SEQ ID NO: 9767 - RNA, 18 nt, artificial
  Chemically synthesized
aacaguggguacaggaug

SEQ ID NO: 9768 - RNA, 18 nt, artificial
  Chemically synthesized
ucuuccaggugggcauuu

SEQ ID NO: 9769 - RNA, 18 nt, artificial
  Chemically synthesized
ucacaaucuuauccaauc

SEQ ID NO: 9770 - RNA, 18 nt, artificial
  Chemically synthesized
ugaacaccagaguuuccu

SEQ ID NO: 9771 - RNA, 18 nt, artificial
  Chemically synthesized
uguggcucacaaucuuau

SEQ ID NO: 9772 - RNA, 18 nt, artificial
  Chemically synthesized
agacacagauggcuggga

SEQ ID NO: 9773 - RNA, 18 nt, artificial
  Chemically synthesized
ugauagcgagccacgcau

SEQ ID NO: 9774 - RNA, 18 nt, artificial
  Chemically synthesized
aauggaaugugcaacacc

SEQ ID NO: 9775 - RNA, 18 nt, artificial
  Chemically synthesized
gaaauuaggcuucauaag

SEQ ID NO: 9776 - RNA, 18 nt, artificial
  Chemically synthesized
ucuuuuccugagucuuuu

SEQ ID NO: 9777 - RNA, 18 nt, artificial
  Chemically synthesized
uccuggucuuaucaugga

SEQ ID NO: 9778 - RNA, 18 nt, artificial
  Chemically synthesized
aacuggguguucacuuuu

SEQ ID NO: 9779 - RNA, 18 nt, artificial
  Chemically synthesized
ccauugcugccaacauca

SEQ ID NO: 9780 - RNA, 18 nt, artificial
  Chemically synthesized
auuuauugcacagacuug

SEQ ID NO: 9781 - RNA, 18 nt, artificial
  Chemically synthesized
cgaauggaaugugcaaca

SEQ ID NO: 9782 - RNA, 18 nt, artificial
  Chemically synthesized
aggaagagaagacaccag

SEQ ID NO: 9783 - RNA, 18 nt, artificial
  Chemically synthesized
ucuugaagaauacaucca

SEQ ID NO: 9784 - RNA, 18 nt, artificial
  Chemically synthesized
aguugaacgaauggaaug

SEQ ID NO: 9785 - RNA, 18 nt, artificial
  Chemically synthesized
guguauuugaaagugugu

SEQ ID NO: 9786 - RNA, 18 nt, artificial
  Chemically synthesized
gauuguugugguguccca

SEQ ID NO: 9787 - RNA, 18 nt, artificial
  Chemically synthesized
caagccaggaugaggacu

SEQ ID NO: 9788 - RNA, 18 nt, artificial
  Chemically synthesized
uaugucugaaugaagcua

SEQ ID NO: 9789 - RNA, 18 nt, artificial
  Chemically synthesized
caccugucagaugaauaa

SEQ ID NO: 9790 - RNA, 18 nt, artificial
  Chemically synthesized
uauggcuguuugagauga

SEQ ID NO: 9791 - RNA, 18 nt, artificial
  Chemically synthesized
cacaacaacuucuuuuca

SEQ ID NO: 9792 - RNA, 18 nt, artificial
  Chemically synthesized
acuaaguaaugacuguca

SEQ ID NO: 9793 - RNA, 18 nt, artificial
  Chemically synthesized
cuucauuuucccugguga

SEQ ID NO: 9794 - RNA, 18 nt, artificial
  Chemically synthesized
gaggcaggaaggaagugg

SEQ ID NO: 9795 - RNA, 18 nt, artificial
  Chemically synthesized
agacgacucagaaaagcc

SEQ ID NO: 9796 - RNA, 18 nt, artificial
  Chemically synthesized
ugguguuauuaccaugag

SEQ ID NO: 9797 - RNA, 18 nt, artificial
  Chemically synthesized
agguucuugauuacaguc

SEQ ID NO: 9798 - RNA, 18 nt, artificial
  Chemically synthesized
cucuuaccucaucaaguu

SEQ ID NO: 9799 - RNA, 18 nt, artificial
  Chemically synthesized
agagccgcugguguaucu

SEQ ID NO: 9800 - RNA, 18 nt, artificial
  Chemically synthesized
uggcaucuucaauggcuu

SEQ ID NO: 9801 - RNA, 18 nt, artificial
  Chemically synthesized
gaugccaggaugaugucu

SEQ ID NO: 9802 - RNA, 18 nt, artificial
  Chemically synthesized
cuuaucauggacaauuug

SEQ ID NO: 9803 - RNA, 18 nt, artificial
  Chemically synthesized
gacaacaaaauucaguug

SEQ ID NO: 9804 - RNA, 18 nt, artificial
  Chemically synthesized
agaguggauguuaucauu

SEQ ID NO: 9805 - RNA, 18 nt, artificial
  Chemically synthesized
cuggcugcauaaaguaug

SEQ ID NO: 9806 - RNA, 18 nt, artificial
  Chemically synthesized
ggugccuccauuucagcu

SEQ ID NO: 9807 - RNA, 18 nt, artificial
  Chemically synthesized
gugauagcgagccacgca

SEQ ID NO: 9808 - RNA, 18 nt, artificial
  Chemically synthesized
acagucucaaucacauaa

SEQ ID NO: 9809 - RNA, 18 nt, artificial
  Chemically synthesized
gucugcaggcguuuucuu

SEQ ID NO: 9810 - RNA, 18 nt, artificial
  Chemically synthesized
gcagugaggaugaugcca

SEQ ID NO: 9811 - RNA, 18 nt, artificial
  Chemically synthesized
ugaaucucuuuagggaga

SEQ ID NO: 9812 - RNA, 18 nt, artificial
  Chemically synthesized
uagugaaaguagaugugu

SEQ ID NO: 9813 - RNA, 18 nt, artificial
  Chemically synthesized
acuugaccuuccuggacc

SEQ ID NO: 9814 - RNA, 18 nt, artificial
  Chemically synthesized
gagauugcucagaccugg

SEQ ID NO: 9815 - RNA, 18 nt, artificial
  Chemically synthesized
aaggaggaagggagaaau

SEQ ID NO: 9816 - RNA, 18 nt, artificial
  Chemically synthesized
uagagaaacaaaagucca

SEQ ID NO: 9817 - RNA, 18 nt, artificial
  Chemically synthesized
aucucuagagaacuuccc

SEQ ID NO: 9818 - RNA, 18 nt, artificial
  Chemically synthesized
ugaacucccuccagguuc

SEQ ID NO: 9819 - RNA, 18 nt, artificial
  Chemically synthesized
cacuuugucacucgaugu

SEQ ID NO: 9820 - RNA, 18 nt, artificial
  Chemically synthesized
uguguuugguuugagcag

SEQ ID NO: 9821 - RNA, 18 nt, artificial
  Chemically synthesized
cucuuuagaccugucccu

SEQ ID NO: 9822 - RNA, 18 nt, artificial
  Chemically synthesized
uguguguccgcaugauca

SEQ ID NO: 9823 - RNA, 18 nt, artificial
  Chemically synthesized
aaagucuaguggcuaauu

SEQ ID NO: 9824 - RNA, 18 nt, artificial
  Chemically synthesized
gaucaaggaccagaggca

SEQ ID NO: 9825 - RNA, 18 nt, artificial
  Chemically synthesized
aaguugaacgaauggaau

SEQ ID NO: 9826 - RNA, 18 nt, artificial
  Chemically synthesized
gaacaucuggauuuccag

SEQ ID NO: 9827 - RNA, 18 nt, artificial
  Chemically synthesized
aaacagaaagagacauug

SEQ ID NO: 9828 - RNA, 18 nt, artificial
  Chemically synthesized
gggccacugcugcucaca

SEQ ID NO: 9829 - RNA, 18 nt, artificial
  Chemically synthesized
gaaacugcucggucagac

SEQ ID NO: 9830 - RNA, 18 nt, artificial
  Chemically synthesized
auguggcucacaaucuua

SEQ ID NO: 9831 - RNA, 18 nt, artificial
  Chemically synthesized
gaguucucuacucuugug

SEQ ID NO: 9832 - RNA, 18 nt, artificial
  Chemically synthesized
ccauuuuaagucugucuc

SEQ ID NO: 9833 - RNA, 18 nt, artificial
  Chemically synthesized
gucugucuccuuacagag

SEQ ID NO: 9834 - RNA, 18 nt, artificial
  Chemically synthesized
acuacgugugaagguauu

SEQ ID NO: 9835 - RNA, 18 nt, artificial
  Chemically synthesized
acaaaggugggaaugcuu

SEQ ID NO: 9836 - RNA, 18 nt, artificial
  Chemically synthesized
caaggaaguauggaaaag

SEQ ID NO: 9837 - RNA, 18 nt, artificial
  Chemically synthesized
gaacccuaugaacuuuau

SEQ ID NO: 9838 - RNA, 18 nt, artificial
  Chemically synthesized
accucugaaucucuuuag

SEQ ID NO: 9839 - RNA, 18 nt, artificial
  Chemically synthesized
ucuucuaacuuccucucc

SEQ ID NO: 9840 - RNA, 18 nt, artificial
  Chemically synthesized
aucucaguagaaauggcu

SEQ ID NO: 9841 - RNA, 18 nt, artificial
  Chemically synthesized
acacaugcucacaaccau

SEQ ID NO: 9842 - RNA, 18 nt, artificial
  Chemically synthesized
augucuauggcuguuuga

SEQ ID NO: 9843 - RNA, 18 nt, artificial
  Chemically synthesized
ucacagagcugagaaacu

SEQ ID NO: 9844 - RNA, 18 nt, artificial
  Chemically synthesized
guggagcuguaccgccuu

SEQ ID NO: 9845 - RNA, 18 nt, artificial
  Chemically synthesized
cucagaaaagcccugcug

SEQ ID NO: 9846 - RNA, 18 nt, artificial
  Chemically synthesized
auccagacaauugaagau

SEQ ID NO: 9847 - RNA, 18 nt, artificial
  Chemically synthesized
auaugagccacaacaacu

SEQ ID NO: 9848 - RNA, 18 nt, artificial
  Chemically synthesized
gugccuccauuucagcuc

SEQ ID NO: 9849 - RNA, 18 nt, artificial
  Chemically synthesized
guguuugguuugagcagg

SEQ ID NO: 9850 - RNA, 18 nt, artificial
  Chemically synthesized
gucccagcacuucaucca

SEQ ID NO: 9851 - RNA, 18 nt, artificial
  Chemically synthesized
acagagacuuuauucccg

SEQ ID NO: 9852 - RNA, 18 nt, artificial
  Chemically synthesized
ggccuuccucuccugcgu

SEQ ID NO: 9853 - RNA, 18 nt, artificial
  Chemically synthesized
ucuugggcuuagaacaac

SEQ ID NO: 9854 - RNA, 18 nt, artificial
  Chemically synthesized
uggagcaguugucuccaa

SEQ ID NO: 9855 - RNA, 18 nt, artificial
  Chemically synthesized
uaaugacugucaugaaag

SEQ ID NO: 9856 - RNA, 18 nt, artificial
  Chemically synthesized
ucaaguuuacagaagcug

SEQ ID NO: 9857 - RNA, 18 nt, artificial
  Chemically synthesized
agugcagagggaauaaau

SEQ ID NO: 9858 - RNA, 18 nt, artificial
  Chemically synthesized
ccugaugcuucuugcugg

SEQ ID NO: 9859 - RNA, 18 nt, artificial
  Chemically synthesized
ucuggcugguuuagaagu

SEQ ID NO: 9860 - RNA, 18 nt, artificial
  Chemically synthesized
ucucuuuagggagacaca

SEQ ID NO: 9861 - RNA, 18 nt, artificial
  Chemically synthesized
ggugucccagcacuucau

SEQ ID NO: 9862 - RNA, 18 nt, artificial
  Chemically synthesized
accugauuaacacaugcu

SEQ ID NO: 9863 - RNA, 18 nt, artificial
  Chemically synthesized
aaaacaaugugucuggaa

SEQ ID NO: 9864 - RNA, 18 nt, artificial
  Chemically synthesized
ucauuguccugcagaagg

SEQ ID NO: 9865 - RNA, 18 nt, artificial
  Chemically synthesized
uccuggaccucucucagu

SEQ ID NO: 9866 - RNA, 18 nt, artificial
  Chemically synthesized
uggacuaucaaguuuaca

SEQ ID NO: 9867 - RNA, 18 nt, artificial
  Chemically synthesized
auugaaaggguaaaagac

SEQ ID NO: 9868 - RNA, 18 nt, artificial
  Chemically synthesized
ucaagaaaaggacaauca

SEQ ID NO: 9869 - RNA, 18 nt, artificial
  Chemically synthesized
acagagucuuccaggugg

SEQ ID NO: 9870 - RNA, 18 nt, artificial
  Chemically synthesized
uccucuccugcgugagac

SEQ ID NO: 9871 - RNA, 18 nt, artificial
  Chemically synthesized
ugcuggaugguaaaucau

SEQ ID NO: 9872 - RNA, 18 nt, artificial
  Chemically synthesized
uucaauggcuuguccagu

SEQ ID NO: 9873 - RNA, 18 nt, artificial
  Chemically synthesized
ugguaucaucuucauugu

SEQ ID NO: 9874 - RNA, 18 nt, artificial
  Chemically synthesized
uucaguauuccuaucacu

SEQ ID NO: 9875 - RNA, 18 nt, artificial
  Chemically synthesized
uuucagaaguugaucuac

SEQ ID NO: 9876 - RNA, 18 nt, artificial
  Chemically synthesized
cucaugaaaugaguugca

SEQ ID NO: 9877 - RNA, 18 nt, artificial
  Chemically synthesized
ucuuacucagaaugacuu

SEQ ID NO: 9878 - RNA, 18 nt, artificial
  Chemically synthesized
acaccuucagauaagcag

SEQ ID NO: 9879 - RNA, 18 nt, artificial
  Chemically synthesized
accagugccucagaaacu

SEQ ID NO: 9880 - RNA, 18 nt, artificial
  Chemically synthesized
uugaaaggguaaaagacu

SEQ ID NO: 9881 - RNA, 18 nt, artificial
  Chemically synthesized
uaguaucuguuguagcag

SEQ ID NO: 9882 - RNA, 18 nt, artificial
  Chemically synthesized
ccagugccucagaaacug

SEQ ID NO: 9883 - RNA, 18 nt, artificial
  Chemically synthesized
gcacuuggaccuuuccag

SEQ ID NO: 9884 - RNA, 18 nt, artificial
  Chemically synthesized
agaaaauuuccgcuuccu

SEQ ID NO: 9885 - RNA, 18 nt, artificial
  Chemically synthesized
ccuuuccagcaacaagau

SEQ ID NO: 9886 - RNA, 18 nt, artificial
  Chemically synthesized
accuccugaggcauuucu

SEQ ID NO: 9887 - RNA, 18 nt, artificial
  Chemically synthesized
ucucaaggagcuuccagu

SEQ ID NO: 9888 - RNA, 18 nt, artificial
  Chemically synthesized
ggaaaaauaaaaaccucc

SEQ ID NO: 9889 - RNA, 18 nt, artificial
  Chemically synthesized
uggaaugugcaacaccuu

SEQ ID NO: 9890 - RNA, 18 nt, artificial
  Chemically synthesized
uagagcacuuggaccuuu

SEQ ID NO: 9891 - RNA, 18 nt, artificial
  Chemically synthesized
augaguucucuacucuug

SEQ ID NO: 9892 - RNA, 18 nt, artificial
  Chemically synthesized
guacacucugucacuuug

SEQ ID NO: 9893 - RNA, 18 nt, artificial
  Chemically synthesized
uggugcacuagauaugca

SEQ ID NO: 9894 - RNA, 18 nt, artificial
  Chemically synthesized
uggugucccagcacuuca

SEQ ID NO: 9895 - RNA, 18 nt, artificial
  Chemically synthesized
auccagccuccucagaaa

SEQ ID NO: 9896 - RNA, 18 nt, artificial
  Chemically synthesized
uucucgagcauguucuau

SEQ ID NO: 9897 - RNA, 18 nt, artificial
  Chemically synthesized
uuuccagcauuccaauuu

SEQ ID NO: 9898 - RNA, 18 nt, artificial
  Chemically synthesized
cucccuccagguucuuga

SEQ ID NO: 9899 - RNA, 18 nt, artificial
  Chemically synthesized
ucuaccaagccuugaguu

SEQ ID NO: 9900 - RNA, 18 nt, artificial
  Chemically synthesized
aggucaccuuuucuugau

SEQ ID NO: 9901 - RNA, 18 nt, artificial
  Chemically synthesized
agagcugagaaacuugac

SEQ ID NO: 9902 - RNA, 18 nt, artificial
  Chemically synthesized
uucuuuuccugagucuuu

SEQ ID NO: 9903 - RNA, 18 nt, artificial
  Chemically synthesized
gugaccucaugaaaugag

SEQ ID NO: 9904 - RNA, 18 nt, artificial
  Chemically synthesized
cugcguggaggugugaaa

SEQ ID NO: 9905 - RNA, 18 nt, artificial
  Chemically synthesized
agguuaaagucuaguggc

SEQ ID NO: 9906 - RNA, 18 nt, artificial
  Chemically synthesized
ggugaccucaugaaauga

SEQ ID NO: 9907 - RNA, 18 nt, artificial
  Chemically synthesized
gcgagccacgcauucaca

SEQ ID NO: 9908 - RNA, 18 nt, artificial
  Chemically synthesized
caaucacauaaugacuuc

SEQ ID NO: 9909 - RNA, 18 nt, artificial
  Chemically synthesized
uguuucagaguguguuug

SEQ ID NO: 9910 - RNA, 18 nt, artificial
  Chemically synthesized
cuuuuucagaaguugauc

SEQ ID NO: 9911 - RNA, 18 nt, artificial
  Chemically synthesized
cuucauccagagccgcug

SEQ ID NO: 9912 - RNA, 18 nt, artificial
  Chemically synthesized
guuuagaaguccaucguu

SEQ ID NO: 9913 - RNA, 18 nt, artificial
  Chemically synthesized
cuuccagauaucuucaca

SEQ ID NO: 9914 - RNA, 18 nt, artificial
  Chemically synthesized
gccuccauuucagcucug

SEQ ID NO: 9915 - RNA, 18 nt, artificial
  Chemically synthesized
caucauuggugugucggu

SEQ ID NO: 9916 - RNA, 18 nt, artificial
  Chemically synthesized
ucuacuugaugacugcag

SEQ ID NO: 9917 - RNA, 18 nt, artificial
  Chemically synthesized
gccucagaaacugcucgg

SEQ ID NO: 9918 - RNA, 18 nt, artificial
  Chemically synthesized
ugaguugcagcagaaguu

SEQ ID NO: 9919 - RNA, 18 nt, artificial
  Chemically synthesized
uccauggugcacuagaua

SEQ ID NO: 9920 - RNA, 18 nt, artificial
  Chemically synthesized
ccuggcugggacucugau

SEQ ID NO: 9921 - RNA, 18 nt, artificial
  Chemically synthesized
caucuucaauggcuuguc

SEQ ID NO: 9922 - RNA, 18 nt, artificial
  Chemically synthesized
cuaaucucaaggagcuuc

SEQ ID NO: 9923 - RNA, 18 nt, artificial
  Chemically synthesized
ugcuaaucucaaggagcu

SEQ ID NO: 9924 - RNA, 18 nt, artificial
  Chemically synthesized
augaccacagucagaagu

SEQ ID NO: 9925 - RNA, 18 nt, artificial
  Chemically synthesized
acaaccagccuaaaguau

SEQ ID NO: 9926 - RNA, 18 nt, artificial
  Chemically synthesized
ccuuccauuuuaagucug

SEQ ID NO: 9927 - RNA, 18 nt, artificial
  Chemically synthesized
gaauuccgauuagcauac

SEQ ID NO: 9928 - RNA, 18 nt, artificial
  Chemically synthesized
caggaacuacagcauuuu

SEQ ID NO: 9929 - RNA, 18 nt, artificial
  Chemically synthesized
gugucgguccucagugug

SEQ ID NO: 9930 - RNA, 18 nt, artificial
  Chemically synthesized
guuugguuugagcagguc

SEQ ID NO: 9931 - RNA, 18 nt, artificial
  Chemically synthesized
aaugcuccuugaccacau

SEQ ID NO: 9932 - RNA, 18 nt, artificial
  Chemically synthesized
cuagaggcaggaaggaag

SEQ ID NO: 9933 - RNA, 18 nt, artificial
  Chemically synthesized
acagcauuuaacucacuc

SEQ ID NO: 9934 - RNA, 18 nt, artificial
  Chemically synthesized
agguggagaagacccugc

SEQ ID NO: 9935 - RNA, 18 nt, artificial
  Chemically synthesized
ugcucagaccuggcaguu

SEQ ID NO: 9936 - RNA, 18 nt, artificial
  Chemically synthesized
cuugccuauaagcuaaua

SEQ ID NO: 9937 - RNA, 18 nt, artificial
  Chemically synthesized
aaucuuacucagaaugac

SEQ ID NO: 9938 - RNA, 18 nt, artificial
  Chemically synthesized
ugaauaucaccugucaga

SEQ ID NO: 9939 - RNA, 18 nt, artificial
  Chemically synthesized
cuaguggcuaauuccuaa

SEQ ID NO: 9940 - RNA, 18 nt, artificial
  Chemically synthesized
gcauaucagagccuaagc

SEQ ID NO: 9941 - RNA, 18 nt, artificial
  Chemically synthesized
cucggucagacggugaua

SEQ ID NO: 9942 - RNA, 18 nt, artificial
  Chemically synthesized
uugugcuuguacaguagu

SEQ ID NO: 9943 - RNA, 18 nt, artificial
  Chemically synthesized
cucuugcuguuucuuuag

SEQ ID NO: 9944 - RNA, 18 nt, artificial
  Chemically synthesized
acaggaacuacagcauuu

SEQ ID NO: 9945 - RNA, 18 nt, artificial
  Chemically synthesized
guugcuuucaauggcauc

SEQ ID NO: 9946 - RNA, 18 nt, artificial
  Chemically synthesized
gauugcucagaccuggca

SEQ ID NO: 9947 - RNA, 18 nt, artificial
  Chemically synthesized
ucucauacucacaccaga

SEQ ID NO: 9948 - RNA, 18 nt, artificial
  Chemically synthesized
cugaacuggguguucacu

SEQ ID NO: 9949 - RNA, 18 nt, artificial
  Chemically synthesized
ugaaaggguaaaagacuu

SEQ ID NO: 9950 - RNA, 18 nt, artificial
  Chemically synthesized
cuuccuggaccucucuca

SEQ ID NO: 9951 - RNA, 18 nt, artificial
  Chemically synthesized
uggcaguuucugagcagu

SEQ ID NO: 9952 - RNA, 18 nt, artificial
  Chemically synthesized
uucaaggcagggaguaua

SEQ ID NO: 9953 - RNA, 18 nt, artificial
  Chemically synthesized
cugggagcccugcgugga

SEQ ID NO: 9954 - RNA, 18 nt, artificial
  Chemically synthesized
agaagcagugaggaugau

SEQ ID NO: 9955 - RNA, 18 nt, artificial
  Chemically synthesized
uugagaugaguucucuac

SEQ ID NO: 9956 - RNA, 18 nt, artificial
  Chemically synthesized
gaacuuuauccaaccagg

SEQ ID NO: 9957 - RNA, 18 nt, artificial
  Chemically synthesized
ucaaggaaguauggaaaa

SEQ ID NO: 9958 - RNA, 18 nt, artificial
  Chemically synthesized
acuaccucgaugauauua

SEQ ID NO: 9959 - RNA, 18 nt, artificial
  Chemically synthesized
cauccagagccgcuggug

SEQ ID NO: 9960 - RNA, 18 nt, artificial
  Chemically synthesized
gaaguguuuguuacugag

SEQ ID NO: 9961 - RNA, 18 nt, artificial
  Chemically synthesized
acuggaaauaugaccaca

SEQ ID NO: 9962 - RNA, 18 nt, artificial
  Chemically synthesized
guuguggugucccagcac

SEQ ID NO: 9963 - RNA, 18 nt, artificial
  Chemically synthesized
gcauaaaguaugguagag

SEQ ID NO: 9964 - RNA, 18 nt, artificial
  Chemically synthesized
uagaacaacuagaacauc

SEQ ID NO: 9965 - RNA, 18 nt, artificial
  Chemically synthesized
ugggcuagaggcaggaag

SEQ ID NO: 9966 - RNA, 18 nt, artificial
  Chemically synthesized
cagacaauugaagauggg

SEQ ID NO: 9967 - RNA, 18 nt, artificial
  Chemically synthesized
cauggugcacuagauaug

SEQ ID NO: 9968 - RNA, 18 nt, artificial
  Chemically synthesized
agguugccgcuuucacuu

SEQ ID NO: 9969 - RNA, 18 nt, artificial
  Chemically synthesized
cuugugcuuguacaguag

SEQ ID NO: 9970 - RNA, 18 nt, artificial
  Chemically synthesized
gaagacaccagugccuca

SEQ ID NO: 9971 - RNA, 18 nt, artificial
  Chemically synthesized
aggaagcaacaucuaucu

SEQ ID NO: 9972 - RNA, 18 nt, artificial
  Chemically synthesized
aaguugaucuaccaagcc

SEQ ID NO: 9973 - RNA, 18 nt, artificial
  Chemically synthesized
aguuugacaaaucugcuc

SEQ ID NO: 9974 - RNA, 18 nt, artificial
  Chemically synthesized
cuaagguugccgcuuuca

SEQ ID NO: 9975 - RNA, 18 nt, artificial
  Chemically synthesized
aucucaaggagcuuccag

SEQ ID NO: 9976 - RNA, 18 nt, artificial
  Chemically synthesized
cauugcugccaacaucau

SEQ ID NO: 9977 - RNA, 18 nt, artificial
  Chemically synthesized
caacuucuuuucauugga

SEQ ID NO: 9978 - RNA, 18 nt, artificial
  Chemically synthesized
acaucuucuggagacgac

SEQ ID NO: 9979 - RNA, 18 nt, artificial
  Chemically synthesized
gcauuugugcacauaucc

SEQ ID NO: 9980 - RNA, 18 nt, artificial
  Chemically synthesized
ugugcuuguaguaucugu

SEQ ID NO: 9981 - RNA, 18 nt, artificial
  Chemically synthesized
ucugaaucucuuuaggga

SEQ ID NO: 9982 - RNA, 18 nt, artificial
  Chemically synthesized
guuuccuguugggcaaug

SEQ ID NO: 9983 - RNA, 18 nt, artificial
  Chemically synthesized
uguccugcagaaggugga

SEQ ID NO: 9984 - RNA, 18 nt, artificial
  Chemically synthesized
gugucugaacucccucca

SEQ ID NO: 9985 - RNA, 18 nt, artificial
  Chemically synthesized
guugaacgaauggaaugu

SEQ ID NO: 9986 - RNA, 18 nt, artificial
  Chemically synthesized
gaaaacuuguauucaagg

SEQ ID NO: 9987 - RNA, 18 nt, artificial
  Chemically synthesized
gccaacaucauccaugaa

SEQ ID NO: 9988 - RNA, 18 nt, artificial
  Chemically synthesized
aaaucauggaauccagaa

SEQ ID NO: 9989 - RNA, 18 nt, artificial
  Chemically synthesized
ucacuuugucacucgaug

SEQ ID NO: 9990 - RNA, 18 nt, artificial
  Chemically synthesized
ugagcaggucuaggguga

SEQ ID NO: 9991 - RNA, 18 nt, artificial
  Chemically synthesized
aguuuacagaagcuggug

SEQ ID NO: 9992 - RNA, 18 nt, artificial
  Chemically synthesized
uccagauaucuucacaga

SEQ ID NO: 9993 - RNA, 18 nt, artificial
  Chemically synthesized
ggaauccagaaggaacag

SEQ ID NO: 9994 - RNA, 18 nt, artificial
  Chemically synthesized
aaagaauguucauccagc

SEQ ID NO: 9995 - RNA, 18 nt, artificial
  Chemically synthesized
ccucaggaggucaccuuu

SEQ ID NO: 9996 - RNA, 18 nt, artificial
  Chemically synthesized
gaggucaccuuuucuuga

SEQ ID NO: 9997 - RNA, 18 nt, artificial
  Chemically synthesized
gaucucaguagaaauggc

SEQ ID NO: 9998 - RNA, 18 nt, artificial
  Chemically synthesized
caauuugggcuagaggca

SEQ ID NO: 9999 - RNA, 18 nt, artificial
  Chemically synthesized
gucuuccaggugggcauu

SEQ ID NO: 10000 - RNA, 18 nt, artificial
  Chemically synthesized
gaaaaguacacucuguca

SEQ ID NO: 10001 - RNA, 18 nt, artificial
  Chemically synthesized
uguguguauuugaaagug

SEQ ID NO: 10002 - RNA, 18 nt, artificial
  Chemically synthesized
aggaccagaggcagcucu

SEQ ID NO: 10003 - RNA, 18 nt, artificial
  Chemically synthesized
ugauuuugggacaaccag

SEQ ID NO: 10004 - RNA, 18 nt, artificial
  Chemically synthesized
ccagcacuucauccagag

SEQ ID NO: 10005 - RNA, 18 nt, artificial
  Chemically synthesized
gcugccaacaucauccau

SEQ ID NO: 10006 - RNA, 18 nt, artificial
  Chemically synthesized
augugcaacaccuucaga

SEQ ID NO: 10007 - RNA, 18 nt, artificial
  Chemically synthesized
acucagaaugacuuugcu

SEQ ID NO: 10008 - RNA, 18 nt, artificial
  Chemically synthesized
aacucuuaccucaucaag

SEQ ID NO: 10009 - RNA, 18 nt, artificial
  Chemically synthesized
ugguuuagaaguccaucg

SEQ ID NO: 10010 - RNA, 18 nt, artificial
  Chemically synthesized
cagaaaccucauuuaccu

SEQ ID NO: 10011 - RNA, 18 nt, artificial
  Chemically synthesized
cuuguccagucucgaagu

SEQ ID NO: 10012 - RNA, 18 nt, artificial
  Chemically synthesized
gaugaugccaggaugaug

SEQ ID NO: 10013 - RNA, 18 nt, artificial
  Chemically synthesized
gaugugugcauuugugca

SEQ ID NO: 10014 - RNA, 18 nt, artificial
  Chemically synthesized
cuuccauuuuaagucugu

SEQ ID NO: 10015 - RNA, 18 nt, artificial
  Chemically synthesized
uccucagaaacagaacau

SEQ ID NO: 10016 - RNA, 18 nt, artificial
  Chemically synthesized
auggaaaaguacacucug

SEQ ID NO: 10017 - RNA, 18 nt, artificial
  Chemically synthesized
gaccacauuuugggaaga

SEQ ID NO: 10018 - RNA, 18 nt, artificial
  Chemically synthesized
agaaacaaaaguccagaa

SEQ ID NO: 10019 - RNA, 18 nt, artificial
  Chemically synthesized
caucccuggguguguuuc

SEQ ID NO: 10020 - RNA, 18 nt, artificial
  Chemically synthesized
uuggacaucucaaaacuu

SEQ ID NO: 10021 - RNA, 18 nt, artificial
  Chemically synthesized
cacuuaccuggaguggga

SEQ ID NO: 10022 - RNA, 18 nt, artificial
  Chemically synthesized
cugcuggaugguaaauca

SEQ ID NO: 10023 - RNA, 18 nt, artificial
  Chemically synthesized
aguccaucguuugguucu

SEQ ID NO: 10024 - RNA, 18 nt, artificial
  Chemically synthesized
cuggguguucacuuuuuc

SEQ ID NO: 10025 - RNA, 18 nt, artificial
  Chemically synthesized
ucuucuggagacgacuca

SEQ ID NO: 10026 - RNA, 18 nt, artificial
  Chemically synthesized
guggcucacaaucuuauc

SEQ ID NO: 10027 - RNA, 18 nt, artificial
  Chemically synthesized
acaucuaugaugccuuug

SEQ ID NO: 10028 - RNA, 18 nt, artificial
  Chemically synthesized
uggguacaggaugcaauu

SEQ ID NO: 10029 - RNA, 18 nt, artificial
  Chemically synthesized
ucuacucuugugcuugua

SEQ ID NO: 10030 - RNA, 18 nt, artificial
  Chemically synthesized
caggaacacuuaccugga

SEQ ID NO: 10031 - RNA, 18 nt, artificial
  Chemically synthesized
aauaugagauugcucaga

SEQ ID NO: 10032 - RNA, 18 nt, artificial
  Chemically synthesized
auuggacaucucaaaacu

SEQ ID NO: 10033 - RNA, 18 nt, artificial
  Chemically synthesized
aaaggcuuacuuucacuu

SEQ ID NO: 10034 - RNA, 18 nt, artificial
  Chemically synthesized
aauuccgauuagcauacu

SEQ ID NO: 10035 - RNA, 18 nt, artificial
  Chemically synthesized
cucgaugauauuauugac

SEQ ID NO: 10036 - RNA, 18 nt, artificial
  Chemically synthesized
cucaagccaggaugagga

SEQ ID NO: 10037 - RNA, 18 nt, artificial
  Chemically synthesized
ucuccaacagcauuuaac

SEQ ID NO: 10038 - RNA, 18 nt, artificial
  Chemically synthesized
cuucucagcaggaacacu

SEQ ID NO: 10039 - RNA, 18 nt, artificial
  Chemically synthesized
caggccuuaugcuaaggg

SEQ ID NO: 10040 - RNA, 18 nt, artificial
  Chemically synthesized
aaaguagaugugugcauu

SEQ ID NO: 10041 - RNA, 18 nt, artificial
  Chemically synthesized
agcugggagcccugcgug

SEQ ID NO: 10042 - RNA, 18 nt, artificial
  Chemically synthesized
uguguguguccgcaugau

SEQ ID NO: 10043 - RNA, 18 nt, artificial
  Chemically synthesized
gcugggacucugauccca

SEQ ID NO: 10044 - RNA, 18 nt, artificial
  Chemically synthesized
acuugaugacugcagucg

SEQ ID NO: 10045 - RNA, 18 nt, artificial
  Chemically synthesized
guuuacagaagcuggugg

SEQ ID NO: 10046 - RNA, 18 nt, artificial
  Chemically synthesized
gccacuggucugcaggcg

SEQ ID NO: 10047 - RNA, 18 nt, artificial
  Chemically synthesized
gaaaaggacaaucaggau

SEQ ID NO: 10048 - RNA, 18 nt, artificial
  Chemically synthesized
auuccuaaggaaaccuga

SEQ ID NO: 10049 - RNA, 18 nt, artificial
  Chemically synthesized
ugaggaaauagggaguug

SEQ ID NO: 10050 - RNA, 18 nt, artificial
  Chemically synthesized
cuggagugggaggacagu

SEQ ID NO: 10051 - RNA, 18 nt, artificial
  Chemically synthesized
aucagggcuguguguauu

SEQ ID NO: 10052 - RNA, 18 nt, artificial
  Chemically synthesized
aaugaguugcagcagaag

SEQ ID NO: 10053 - RNA, 18 nt, artificial
  Chemically synthesized
auggaccucugaaucucu

SEQ ID NO: 10054 - RNA, 18 nt, artificial
  Chemically synthesized
cucugccuucacuacaga

SEQ ID NO: 10055 - RNA, 18 nt, artificial
  Chemically synthesized
gcagcucuugguggaagu

SEQ ID NO: 10056 - RNA, 18 nt, artificial
  Chemically synthesized
gaaguugaucuaccaagc

SEQ ID NO: 10057 - RNA, 18 nt, artificial
  Chemically synthesized
gucaccuuuucuugauuc

SEQ ID NO: 10058 - RNA, 18 nt, artificial
  Chemically synthesized
aaaugaguugcagcagaa

SEQ ID NO: 10059 - RNA, 18 nt, artificial
  Chemically synthesized
auggaaugugcaacaccu

SEQ ID NO: 10060 - RNA, 18 nt, artificial
  Chemically synthesized
aaucugaccaaucuagag

SEQ ID NO: 10061 - RNA, 18 nt, artificial
  Chemically synthesized
gagaagacccugcucagg

SEQ ID NO: 10062 - RNA, 18 nt, artificial
  Chemically synthesized
gggaugaccucaggaggu

SEQ ID NO: 10063 - RNA, 18 nt, artificial
  Chemically synthesized
gaccuuccuggaccucuc

SEQ ID NO: 10064 - RNA, 18 nt, artificial
  Chemically synthesized
gugggaugaccucaggag

SEQ ID NO: 10065 - RNA, 18 nt, artificial
  Chemically synthesized
guacuagugaaaguagau

SEQ ID NO: 10066 - RNA, 18 nt, artificial
  Chemically synthesized
accagccuaaaguauuua

SEQ ID NO: 10067 - RNA, 18 nt, artificial
  Chemically synthesized
gcccagcuggguccaaca

SEQ ID NO: 10068 - RNA, 18 nt, artificial
  Chemically synthesized
ugucacuuugucacucga

SEQ ID NO: 10069 - RNA, 18 nt, artificial
  Chemically synthesized
accuggagugggaggaca

SEQ ID NO: 10070 - RNA, 18 nt, artificial
  Chemically synthesized
uccaaaaaacaggaacua

SEQ ID NO: 10071 - RNA, 18 nt, artificial
  Chemically synthesized
gcaggcguuuucuucuuc

SEQ ID NO: 10072 - RNA, 18 nt, artificial
  Chemically synthesized
gucuugccuauaagcuaa

SEQ ID NO: 10073 - RNA, 18 nt, artificial
  Chemically synthesized
cuccugaggcauuucuug

SEQ ID NO: 10074 - RNA, 18 nt, artificial
  Chemically synthesized
ucacuuccaacaaaggug

SEQ ID NO: 10075 - RNA, 18 nt, artificial
  Chemically synthesized
ugaguguuucagagugug

SEQ ID NO: 10076 - RNA, 18 nt, artificial
  Chemically synthesized
acgugcuucaaauaucca

SEQ ID NO: 10077 - RNA, 18 nt, artificial
  Chemically synthesized
agugaaaguagaugugug

SEQ ID NO: 10078 - RNA, 18 nt, artificial
  Chemically synthesized
gcaauggaucaaggacca

SEQ ID NO: 10079 - RNA, 18 nt, artificial
  Chemically synthesized
augacuuugcuuguacuu

SEQ ID NO: 10080 - RNA, 18 nt, artificial
  Chemically synthesized
acuucauccagagccgcu

SEQ ID NO: 10081 - RNA, 18 nt, artificial
  Chemically synthesized
caggaaaacuuccuucca

SEQ ID NO: 10082 - RNA, 18 nt, artificial
  Chemically synthesized
cugccaggagaacuacgu

SEQ ID NO: 10083 - RNA, 18 nt, artificial
  Chemically synthesized
ccuuccucuccugcguga

SEQ ID NO: 10084 - RNA, 18 nt, artificial
  Chemically synthesized
ucgaugucauuccaaagu

SEQ ID NO: 10085 - RNA, 18 nt, artificial
  Chemically synthesized
ugaagguuuccauaaaag

SEQ ID NO: 10086 - RNA, 18 nt, artificial
  Chemically synthesized
gucauuucaacucuuacc

SEQ ID NO: 10087 - RNA, 18 nt, artificial
  Chemically synthesized
gugauguuugauggaccu

SEQ ID NO: 10088 - RNA, 18 nt, artificial
  Chemically synthesized
cgagccacgcauucacag

SEQ ID NO: 10089 - RNA, 18 nt, artificial
  Chemically synthesized
guauggaaaaguacacuc

SEQ ID NO: 10090 - RNA, 18 nt, artificial
  Chemically synthesized
ucaugaaaugaguugcag

SEQ ID NO: 10091 - RNA, 18 nt, artificial
  Chemically synthesized
ucgaggaagagaagacac

SEQ ID NO: 10092 - RNA, 18 nt, artificial
  Chemically synthesized
caugcucacaaccauccu

SEQ ID NO: 10093 - RNA, 18 nt, artificial
  Chemically synthesized
gacucagaaaagcccugc

SEQ ID NO: 10094 - RNA, 18 nt, artificial
  Chemically synthesized
aacaaaggugggaaugcu

SEQ ID NO: 10095 - RNA, 18 nt, artificial
  Chemically synthesized
cucaaagugauuuuggga

SEQ ID NO: 10096 - RNA, 18 nt, artificial
  Chemically synthesized
cacuucauccagagccgc

SEQ ID NO: 10097 - RNA, 18 nt, artificial
  Chemically synthesized
guaccgccuucucagcag

SEQ ID NO: 10098 - RNA, 18 nt, artificial
  Chemically synthesized
uguaccgccuucucagca

SEQ ID NO: 10099 - RNA, 18 nt, artificial
  Chemically synthesized
ucucaaucacauaaugac

SEQ ID NO: 10100 - RNA, 18 nt, artificial
  Chemically synthesized
ucucgaagucuugaaaau

SEQ ID NO: 10101 - RNA, 18 nt, artificial
  Chemically synthesized
ccauggccuuccucuccu

SEQ ID NO: 10102 - RNA, 18 nt, artificial
  Chemically synthesized
cuugaugacugcagucgu

SEQ ID NO: 10103 - RNA, 18 nt, artificial
  Chemically synthesized
ucaaaucucucaaaaggc

SEQ ID NO: 10104 - RNA, 18 nt, artificial
  Chemically synthesized
ugcugguaucaucuucau

SEQ ID NO: 10105 - RNA, 18 nt, artificial
  Chemically synthesized
gcacuucauccagagccg

SEQ ID NO: 10106 - RNA, 18 nt, artificial
  Chemically synthesized
gucauucucgagcauguu

SEQ ID NO: 10107 - RNA, 18 nt, artificial
  Chemically synthesized
gugucuggaauuaauggg

SEQ ID NO: 10108 - RNA, 18 nt, artificial
  Chemically synthesized
cacauugaaacucaaauc

SEQ ID NO: 10109 - RNA, 18 nt, artificial
  Chemically synthesized
auuugaaagugugugugu

SEQ ID NO: 10110 - RNA, 18 nt, artificial
  Chemically synthesized
aaaacaucuaugaugccu

SEQ ID NO: 10111 - RNA, 18 nt, artificial
  Chemically synthesized
uuuccugagucuuuugaa

SEQ ID NO: 10112 - RNA, 18 nt, artificial
  Chemically synthesized
ugaaggaaacuuggaaaa

SEQ ID NO: 10113 - RNA, 18 nt, artificial
  Chemically synthesized
uacagagucuuccaggug

SEQ ID NO: 10114 - RNA, 18 nt, artificial
  Chemically synthesized
caauucuuuccaggaaaa

SEQ ID NO: 10115 - RNA, 18 nt, artificial
  Chemically synthesized
cugggacucugaucccag

SEQ ID NO: 10116 - RNA, 18 nt, artificial
  Chemically synthesized
agaaguccaucguuuggu

SEQ ID NO: 10117 - RNA, 18 nt, artificial
  Chemically synthesized
auucuuuccaggaaaacu

SEQ ID NO: 10118 - RNA, 18 nt, artificial
  Chemically synthesized
uaagccaccucucuaccu

SEQ ID NO: 10119 - RNA, 18 nt, artificial
  Chemically synthesized
ugcucuagagggccugug

SEQ ID NO: 10120 - RNA, 18 nt, artificial
  Chemically synthesized
agggaauaaaugcuagac

SEQ ID NO: 10121 - RNA, 18 nt, artificial
  Chemically synthesized
caacaucauccaugaagg

SEQ ID NO: 10122 - RNA, 18 nt, artificial
  Chemically synthesized
aauggaugucuauggcug

SEQ ID NO: 10123 - RNA, 18 nt, artificial
  Chemically synthesized
uuucagaacaagugaugu

SEQ ID NO: 10124 - RNA, 18 nt, artificial
  Chemically synthesized
acuuccuuccagauaucu

SEQ ID NO: 10125 - RNA, 18 nt, artificial
  Chemically synthesized
ccaaucuuucaaauuacc

SEQ ID NO: 10126 - RNA, 18 nt, artificial
  Chemically synthesized
agaaaccucauuuaccuu

SEQ ID NO: 10127 - RNA, 18 nt, artificial
  Chemically synthesized
ggcaucuucaauggcuug

SEQ ID NO: 10128 - RNA, 18 nt, artificial
  Chemically synthesized
ugcuggcugcauaaagua

SEQ ID NO: 10129 - RNA, 18 nt, artificial
  Chemically synthesized
acuuccucucacccuuua

SEQ ID NO: 10130 - RNA, 18 nt, artificial
  Chemically synthesized
cagugucaacuggagcag

SEQ ID NO: 10131 - RNA, 18 nt, artificial
  Chemically synthesized
agccacgcauucacaggg

SEQ ID NO: 10132 - RNA, 18 nt, artificial
  Chemically synthesized
ccuccauuucagcucugc

SEQ ID NO: 10133 - RNA, 18 nt, artificial
  Chemically synthesized
ugccuccauuucagcucu

SEQ ID NO: 10134 - RNA, 18 nt, artificial
  Chemically synthesized
uacagagguuaaagucua

SEQ ID NO: 10135 - RNA, 18 nt, artificial
  Chemically synthesized
acaaaucugcucuagagg

SEQ ID NO: 10136 - RNA, 18 nt, artificial
  Chemically synthesized
uccagagccgcuggugua

SEQ ID NO: 10137 - RNA, 18 nt, artificial
  Chemically synthesized
augguagaggugaaaaca

SEQ ID NO: 10138 - RNA, 18 nt, artificial
  Chemically synthesized
aacgaauggaaugugcaa

SEQ ID NO: 10139 - RNA, 18 nt, artificial
  Chemically synthesized
aagguuguuuaagacgug

SEQ ID NO: 10140 - RNA, 18 nt, artificial
  Chemically synthesized
agcuggguccaacacuug

SEQ ID NO: 10141 - RNA, 18 nt, artificial
  Chemically synthesized
ugaugcuucuugcuggcu

SEQ ID NO: 10142 - RNA, 18 nt, artificial
  Chemically synthesized
gucugaacucccuccagg

SEQ ID NO: 10143 - RNA, 18 nt, artificial
  Chemically synthesized
uguguccgcaugaucaua

SEQ ID NO: 10144 - RNA, 18 nt, artificial
  Chemically synthesized
acauugcuguuuccuguu

SEQ ID NO: 10145 - RNA, 18 nt, artificial
  Chemically synthesized
agguggagcuguaccgcc

SEQ ID NO: 10146 - RNA, 18 nt, artificial
  Chemically synthesized
uuuggacaguuucccaca

SEQ ID NO: 10147 - RNA, 18 nt, artificial
  Chemically synthesized
ucuaacuuccucuccugu

SEQ ID NO: 10148 - RNA, 18 nt, artificial
  Chemically synthesized
uucucuacucuugugcuu

SEQ ID NO: 10149 - RNA, 18 nt, artificial
  Chemically synthesized
ucagaaaccucauuuacc

SEQ ID NO: 10150 - RNA, 18 nt, artificial
  Chemically synthesized
ugugcuuguacaguaguc

SEQ ID NO: 10151 - RNA, 18 nt, artificial
  Chemically synthesized
cauuuuuuuacgucuugc

SEQ ID NO: 10152 - RNA, 18 nt, artificial
  Chemically synthesized
cuagacuaaaauacagag

SEQ ID NO: 10153 - RNA, 18 nt, artificial
  Chemically synthesized
aauaagaccaucauuggu

SEQ ID NO: 10154 - RNA, 18 nt, artificial
  Chemically synthesized
ggagacacagauggcugg

SEQ ID NO: 10155 - RNA, 18 nt, artificial
  Chemically synthesized
uuugacaaaucugcucua

SEQ ID NO: 10156 - RNA, 18 nt, artificial
  Chemically synthesized
aacuucuugggcuuagaa

SEQ ID NO: 10157 - RNA, 18 nt, artificial
  Chemically synthesized
aggcagcucuugguggaa

SEQ ID NO: 10158 - RNA, 18 nt, artificial
  Chemically synthesized
ugucaacuggagcaguug

SEQ ID NO: 10159 - RNA, 18 nt, artificial
  Chemically synthesized
agagcacuuggaccuuuc

SEQ ID NO: 10160 - RNA, 18 nt, artificial
  Chemically synthesized
uucagaguguguuugguu

SEQ ID NO: 10161 - RNA, 18 nt, artificial
  Chemically synthesized
accacauuuugggaagag

SEQ ID NO: 10162 - RNA, 18 nt, artificial
  Chemically synthesized
augacugucaugaaagca

SEQ ID NO: 10163 - RNA, 18 nt, artificial
  Chemically synthesized
aauaugagccacaacaac

SEQ ID NO: 10164 - RNA, 18 nt, artificial
  Chemically synthesized
gagguuaaagucuagugg

SEQ ID NO: 10165 - RNA, 18 nt, artificial
  Chemically synthesized
augacuuccaaaaaacag

SEQ ID NO: 10166 - RNA, 18 nt, artificial
  Chemically synthesized
uggagugggaggacagug

SEQ ID NO: 10167 - RNA, 18 nt, artificial
  Chemically synthesized
aaguuugacaaaucugcu

SEQ ID NO: 10168 - RNA, 18 nt, artificial
  Chemically synthesized
uaucccuauguaucccua

SEQ ID NO: 10169 - RNA, 18 nt, artificial
  Chemically synthesized
gccuucucagcaggaaca

SEQ ID NO: 10170 - RNA, 18 nt, artificial
  Chemically synthesized
aucuagagcacuuggacc

SEQ ID NO: 10171 - RNA, 18 nt, artificial
  Chemically synthesized
cuggucauucucgagcau

SEQ ID NO: 10172 - RNA, 18 nt, artificial
  Chemically synthesized
ucccuaucagggcugugu

SEQ ID NO: 10173 - RNA, 18 nt, artificial
  Chemically synthesized
cagagguuaaagucuagu

SEQ ID NO: 10174 - RNA, 18 nt, artificial
  Chemically synthesized
cucaggaggucaccuuuu

SEQ ID NO: 10175 - RNA, 18 nt, artificial
  Chemically synthesized
agagggccugugcaauuu

SEQ ID NO: 10176 - RNA, 18 nt, artificial
  Chemically synthesized
gagcuuccagugcagagg

SEQ ID NO: 10177 - RNA, 18 nt, artificial
  Chemically synthesized
uuagcauacuuagacuac

SEQ ID NO: 10178 - RNA, 18 nt, artificial
  Chemically synthesized
ugauguuugauggaccuc

SEQ ID NO: 10179 - RNA, 18 nt, artificial
  Chemically synthesized
ugcugcucacagaagcag

SEQ ID NO: 10180 - RNA, 18 nt, artificial
  Chemically synthesized
cucugaucccagccaugg

SEQ ID NO: 10181 - RNA, 18 nt, artificial
  Chemically synthesized
auggcuguuugagaugag

SEQ ID NO: 10182 - RNA, 18 nt, artificial
  Chemically synthesized
ugcguggaggugugaaau

SEQ ID NO: 10183 - RNA, 18 nt, artificial
  Chemically synthesized
guucuacaucaaaugccc

SEQ ID NO: 10184 - RNA, 18 nt, artificial
  Chemically synthesized
cccauccagaguuuagcc

SEQ ID NO: 10185 - RNA, 18 nt, artificial
  Chemically synthesized
ucuaugaugccuuuguua

SEQ ID NO: 10186 - RNA, 18 nt, artificial
  Chemically synthesized
aaguacacucugucacuu

SEQ ID NO: 10187 - RNA, 18 nt, artificial
  Chemically synthesized
acuuuauccaaccaggug

SEQ ID NO: 10188 - RNA, 18 nt, artificial
  Chemically synthesized
aauuaggcuucauaagcu

SEQ ID NO: 10189 - RNA, 18 nt, artificial
  Chemically synthesized
agauggcugggaucccuc

SEQ ID NO: 10190 - RNA, 18 nt, artificial
  Chemically synthesized
aauccagaaggaacagug

SEQ ID NO: 10191 - RNA, 18 nt, artificial
  Chemically synthesized
ucucauguacuagugaaa

SEQ ID NO: 10192 - RNA, 18 nt, artificial
  Chemically synthesized
ugaaaauggcuggcaauu

SEQ ID NO: 10193 - RNA, 18 nt, artificial
  Chemically synthesized
ggagcccugcguggaggu

SEQ ID NO: 10194 - RNA, 18 nt, artificial
  Chemically synthesized
cuauuuucaccugaugcu

SEQ ID NO: 10195 - RNA, 18 nt, artificial
  Chemically synthesized
guauuaaaugcugccaca

SEQ ID NO: 10196 - RNA, 18 nt, artificial
  Chemically synthesized
acuacagcauuuuccaag

SEQ ID NO: 10197 - RNA, 18 nt, artificial
  Chemically synthesized
cuaagccaccucucuacc

SEQ ID NO: 10198 - RNA, 18 nt, artificial
  Chemically synthesized
uuugcuuguacuugugaa

SEQ ID NO: 10199 - RNA, 18 nt, artificial
  Chemically synthesized
ugcauuugugcacauauc

SEQ ID NO: 10200 - RNA, 18 nt, artificial
  Chemically synthesized
ugggacaaccagccuaaa

SEQ ID NO: 10201 - RNA, 18 nt, artificial
  Chemically synthesized
auguaucccuaucagggc

SEQ ID NO: 10202 - RNA, 18 nt, artificial
  Chemically synthesized
uauacauugcuguuuccu

SEQ ID NO: 10203 - RNA, 18 nt, artificial
  Chemically synthesized
gcauuucuugcccagcug

SEQ ID NO: 10204 - RNA, 18 nt, artificial
  Chemically synthesized
cacugccaggagaacuac

SEQ ID NO: 10205 - RNA, 18 nt, artificial
  Chemically synthesized
aaccauccuggucauucu

SEQ ID NO: 10206 - RNA, 18 nt, artificial
  Chemically synthesized
aaucuagagcacuuggac

SEQ ID NO: 10207 - RNA, 18 nt, artificial
  Chemically synthesized
acagagaaaacagaaaga

SEQ ID NO: 10208 - RNA, 18 nt, artificial
  Chemically synthesized
cauuugugcacauauccc

SEQ ID NO: 10209 - RNA, 18 nt, artificial
  Chemically synthesized
guuugagcaggucuaggg

SEQ ID NO: 10210 - RNA, 18 nt, artificial
  Chemically synthesized
uuccugagucuuuugaau

SEQ ID NO: 10211 - RNA, 18 nt, artificial
  Chemically synthesized
guaucccuaucagggcug

SEQ ID NO: 10212 - RNA, 18 nt, artificial
  Chemically synthesized
ugagcuucaaugguguua

SEQ ID NO: 10213 - RNA, 18 nt, artificial
  Chemically synthesized
acuggucugcaggcguuu

SEQ ID NO: 10214 - RNA, 18 nt, artificial
  Chemically synthesized
cccugcuggaugguaaau

SEQ ID NO: 10215 - RNA, 18 nt, artificial
  Chemically synthesized
uaacucacucuccagucu

SEQ ID NO: 10216 - RNA, 18 nt, artificial
  Chemically synthesized
aggcuucauaagcugacu

SEQ ID NO: 10217 - RNA, 18 nt, artificial
  Chemically synthesized
cucauacucacaccagag

SEQ ID NO: 10218 - RNA, 18 nt, artificial
  Chemically synthesized
uacucaagccaggaugag

SEQ ID NO: 10219 - RNA, 18 nt, artificial
  Chemically synthesized
auggaugucuauggcugu

SEQ ID NO: 10220 - RNA, 18 nt, artificial
  Chemically synthesized
gggagcccugcguggagg

SEQ ID NO: 10221 - RNA, 18 nt, artificial
  Chemically synthesized
uuggacaguuucccacau

SEQ ID NO: 10222 - RNA, 18 nt, artificial
  Chemically synthesized
cagauggcugggaucccu

SEQ ID NO: 10223 - RNA, 18 nt, artificial
  Chemically synthesized
gacgacucagaaaagccc

SEQ ID NO: 10224 - RNA, 18 nt, artificial
  Chemically synthesized
auacuuagacuacuaccu

SEQ ID NO: 10225 - RNA, 18 nt, artificial
  Chemically synthesized
aacauaugggcugauaaa

SEQ ID NO: 10226 - RNA, 18 nt, artificial
  Chemically synthesized
agggcugcuaaucucaag

SEQ ID NO: 10227 - RNA, 18 nt, artificial
  Chemically synthesized
gggugccuccauuucagc

SEQ ID NO: 10228 - RNA, 18 nt, artificial
  Chemically synthesized
acuuguauucaaggucug

SEQ ID NO: 10229 - RNA, 18 nt, artificial
  Chemically synthesized
guauuugaaagugugugu

SEQ ID NO: 10230 - RNA, 18 nt, artificial
  Chemically synthesized
ugaaagaacuuaaugugg

SEQ ID NO: 10231 - RNA, 18 nt, artificial
  Chemically synthesized
cgggaagaaaauuuccgc

SEQ ID NO: 10232 - RNA, 18 nt, artificial
  Chemically synthesized
uguuuccuguugggcaau

SEQ ID NO: 10233 - RNA, 18 nt, artificial
  Chemically synthesized
uagcgagccacgcauuca

SEQ ID NO: 10234 - RNA, 18 nt, artificial
  Chemically synthesized
cauuuugguaguuuugac

SEQ ID NO: 10235 - RNA, 18 nt, artificial
  Chemically synthesized
ccuucucagcaggaacac

SEQ ID NO: 10236 - RNA, 18 nt, artificial
  Chemically synthesized
ccucugaaucucuuuagg

SEQ ID NO: 10237 - RNA, 18 nt, artificial
  Chemically synthesized
gccacgcauucacagggc

SEQ ID NO: 10238 - RNA, 18 nt, artificial
  Chemically synthesized
uguauucaaggucuggcu

SEQ ID NO: 10239 - RNA, 18 nt, artificial
  Chemically synthesized
guggaaguugaacgaaug

SEQ ID NO: 10240 - RNA, 18 nt, artificial
  Chemically synthesized
gaagacccugcucaggca

SEQ ID NO: 10241 - RNA, 18 nt, artificial
  Chemically synthesized
cuaaaauacagagucuuc

SEQ ID NO: 10242 - RNA, 18 nt, artificial
  Chemically synthesized
gaccagaggcagcucuug

SEQ ID NO: 10243 - RNA, 18 nt, artificial
  Chemically synthesized
aaaauggcuggcaauucu

SEQ ID NO: 10244 - RNA, 18 nt, artificial
  Chemically synthesized
uucuugggcuuagaacaa

SEQ ID NO: 10245 - RNA, 18 nt, artificial
  Chemically synthesized
uguauuugaaagugugug

SEQ ID NO: 10246 - RNA, 18 nt, artificial
  Chemically synthesized
cucgaugucauuccaaag

SEQ ID NO: 10247 - RNA, 18 nt, artificial
  Chemically synthesized
aucugagcuucaauggug

SEQ ID NO: 10248 - RNA, 18 nt, artificial
  Chemically synthesized
aauggcuuguccagucuc

SEQ ID NO: 10249 - RNA, 18 nt, artificial
  Chemically synthesized
acauccauuugaaaugga

SEQ ID NO: 10250 - RNA, 18 nt, artificial
  Chemically synthesized
gaccucaugaaaugaguu

SEQ ID NO: 10251 - RNA, 18 nt, artificial
  Chemically synthesized
accucaugaaaugaguug

SEQ ID NO: 10252 - RNA, 18 nt, artificial
  Chemically synthesized
cggugauagcgagccacg

SEQ ID NO: 10253 - RNA, 18 nt, artificial
  Chemically synthesized
cguuuccuuauaaguguc

SEQ ID NO: 10254 - RNA, 18 nt, artificial
  Chemically synthesized
gaacaccagaguuuccug

SEQ ID NO: 10255 - RNA, 18 nt, artificial
  Chemically synthesized
aaaccucauuuaccuuga

SEQ ID NO: 10256 - RNA, 18 nt, artificial
  Chemically synthesized
cuagagggccugugcaau

SEQ ID NO: 10257 - RNA, 18 nt, artificial
  Chemically synthesized
aaauagggaguugucuaa

SEQ ID NO: 10258 - RNA, 18 nt, artificial
  Chemically synthesized
ccuguugggcaaugcucc

SEQ ID NO: 10259 - RNA, 18 nt, artificial
  Chemically synthesized
ugugugcauuugugcaca

SEQ ID NO: 10260 - RNA, 18 nt, artificial
  Chemically synthesized
aguauggaaaaguacacu

SEQ ID NO: 10261 - RNA, 18 nt, artificial
  Chemically synthesized
aggaaauagggaguuguc

SEQ ID NO: 10262 - RNA, 18 nt, artificial
  Chemically synthesized
ugaguucaaacuucuugg

SEQ ID NO: 10263 - RNA, 18 nt, artificial
  Chemically synthesized
ucagggcuguguguauuu

SEQ ID NO: 10264 - RNA, 18 nt, artificial
  Chemically synthesized
aggaacacuuaccuggag

SEQ ID NO: 10265 - RNA, 18 nt, artificial
  Chemically synthesized
cauaaaguaugguagagg

SEQ ID NO: 10266 - RNA, 18 nt, artificial
  Chemically synthesized
agagacauuguucuuuuc

SEQ ID NO: 10267 - RNA, 18 nt, artificial
  Chemically synthesized
aacccaugacaaagaaag

SEQ ID NO: 10268 - RNA, 18 nt, artificial
  Chemically synthesized
uugagaaaacaauguguc

SEQ ID NO: 10269 - RNA, 18 nt, artificial
  Chemically synthesized
ucuuucaaauuaccugag

SEQ ID NO: 10270 - RNA, 18 nt, artificial
  Chemically synthesized
gaugccuuuguuaucuac

SEQ ID NO: 10271 - RNA, 18 nt, artificial
  Chemically synthesized
ucuugguggaaguugaac

SEQ ID NO: 10272 - RNA, 18 nt, artificial
  Chemically synthesized
uagaggugaaaacaucua

SEQ ID NO: 10273 - RNA, 18 nt, artificial
  Chemically synthesized
aguaauuccauggugcac

SEQ ID NO: 10274 - RNA, 18 nt, artificial
  Chemically synthesized
aaggaacaguggguacag

SEQ ID NO: 10275 - RNA, 18 nt, artificial
  Chemically synthesized
ccugucccugaacccuau

SEQ ID NO: 10276 - RNA, 18 nt, artificial
  Chemically synthesized
auugcuguuuccuguugg

SEQ ID NO: 10277 - RNA, 18 nt, artificial
  Chemically synthesized
uacucagaaugacuuugc

SEQ ID NO: 10278 - RNA, 18 nt, artificial
  Chemically synthesized
gauuccagaaacauaugg

SEQ ID NO: 10279 - RNA, 18 nt, artificial
  Chemically synthesized
gcacuagauaugcagggc

SEQ ID NO: 10280 - RNA, 18 nt, artificial
  Chemically synthesized
cucaaggagcuuccagug

SEQ ID NO: 10281 - RNA, 18 nt, artificial
  Chemically synthesized
gaagugggaugaccucag

SEQ ID NO: 10282 - RNA, 18 nt, artificial
  Chemically synthesized
gcccugcuggaugguaaa

SEQ ID NO: 10283 - RNA, 18 nt, artificial
  Chemically synthesized
ucacaccagaguugcuuu

SEQ ID NO: 10284 - RNA, 18 nt, artificial
  Chemically synthesized
ucuagggugauugaacau

SEQ ID NO: 10285 - RNA, 18 nt, artificial
  Chemically synthesized
ucaguagaaauggcuuga

SEQ ID NO: 10286 - RNA, 18 nt, artificial
  Chemically synthesized
cucagcaggaacacuuac

SEQ ID NO: 10287 - RNA, 18 nt, artificial
  Chemically synthesized
uccagaaacauaugggcu

SEQ ID NO: 10288 - RNA, 18 nt, artificial
  Chemically synthesized
cuuguauucaaggucugg

SEQ ID NO: 10289 - RNA, 18 nt, artificial
  Chemically synthesized
cuacucaagccaggauga

SEQ ID NO: 10290 - RNA, 18 nt, artificial
  Chemically synthesized
ugaauacaccaauugcug

SEQ ID NO: 10291 - RNA, 18 nt, artificial
  Chemically synthesized
ugaaaacaucuaugaugc

SEQ ID NO: 10292 - RNA, 18 nt, artificial
  Chemically synthesized
agcccugggagccuuuuc

SEQ ID NO: 10293 - RNA, 18 nt, artificial
  Chemically synthesized
gccuggcugggacucuga

SEQ ID NO: 10294 - RNA, 18 nt, artificial
  Chemically synthesized
auuguucuuuuccugagu

SEQ ID NO: 10295 - RNA, 18 nt, artificial
  Chemically synthesized
cacuuccaacaaaggugg

SEQ ID NO: 10296 - RNA, 18 nt, artificial
  Chemically synthesized
guucccagaaaagaaugu

SEQ ID NO: 10297 - RNA, 18 nt, artificial
  Chemically synthesized
agugugcuuguaguaucu

SEQ ID NO: 10298 - RNA, 18 nt, artificial
  Chemically synthesized
ugaccucaugaaaugagu

SEQ ID NO: 10299 - RNA, 18 nt, artificial
  Chemically synthesized
auaaaagccgaaagguga

SEQ ID NO: 10300 - RNA, 18 nt, artificial
  Chemically synthesized
aagugauuuugggacaac

SEQ ID NO: 10301 - RNA, 18 nt, artificial
  Chemically synthesized
acuagugaaaguagaugu

SEQ ID NO: 10302 - RNA, 18 nt, artificial
  Chemically synthesized
guucucaaagugauuuug

SEQ ID NO: 10303 - RNA, 18 nt, artificial
  Chemically synthesized
gaaugcuaagguugccgc

SEQ ID NO: 10304 - RNA, 18 nt, artificial
  Chemically synthesized
cuccuugaccacauuuug

SEQ ID NO: 10305 - RNA, 18 nt, artificial
  Chemically synthesized
cuggguccaacacuuguu

SEQ ID NO: 10306 - RNA, 18 nt, artificial
  Chemically synthesized
ugcgugagaccagaaagc

SEQ ID NO: 10307 - RNA, 18 nt, artificial
  Chemically synthesized
uaagguugccgcuuucac

SEQ ID NO: 10308 - RNA, 18 nt, artificial
  Chemically synthesized
ugguaguuuugacugaac

SEQ ID NO: 10309 - RNA, 18 nt, artificial
  Chemically synthesized
uacacucugucacuuugu

SEQ ID NO: 10310 - RNA, 18 nt, artificial
  Chemically synthesized
ucuuuucauuggauacgu

SEQ ID NO: 10311 - RNA, 18 nt, artificial
  Chemically synthesized
aggaaacuuggaaaaguu

SEQ ID NO: 10312 - RNA, 18 nt, artificial
  Chemically synthesized
aauuuggacaguuuccca

SEQ ID NO: 10313 - RNA, 18 nt, artificial
  Chemically synthesized
cccagcuggguccaacac

SEQ ID NO: 10314 - RNA, 18 nt, artificial
  Chemically synthesized
ccucgcgccuggcuggga

SEQ ID NO: 10315 - RNA, 18 nt, artificial
  Chemically synthesized
cuggucugcaggcguuuu

SEQ ID NO: 10316 - RNA, 18 nt, artificial
  Chemically synthesized
uguguauuugaaagugug

SEQ ID NO: 10317 - RNA, 18 nt, artificial
  Chemically synthesized
uggaaaaguacacucugu

SEQ ID NO: 10318 - RNA, 18 nt, artificial
  Chemically synthesized
aggaugaggacuggguaa

SEQ ID NO: 10319 - RNA, 18 nt, artificial
  Chemically synthesized
cagaaacauaugggcuga

SEQ ID NO: 10320 - RNA, 18 nt, artificial
  Chemically synthesized
agggccugugcaauuuga

SEQ ID NO: 10321 - RNA, 18 nt, artificial
  Chemically synthesized
gagcccugcguggaggug

SEQ ID NO: 10322 - RNA, 18 nt, artificial
  Chemically synthesized
aagguggagaagacccug

SEQ ID NO: 10323 - RNA, 18 nt, artificial
  Chemically synthesized
uuauaaagaagguuccca

SEQ ID NO: 10324 - RNA, 18 nt, artificial
  Chemically synthesized
uugguuugagcaggucua

SEQ ID NO: 10325 - RNA, 18 nt, artificial
  Chemically synthesized
uaucaaguuuacagaagc

SEQ ID NO: 10326 - RNA, 18 nt, artificial
  Chemically synthesized
ugucaggccuuaugcuaa

SEQ ID NO: 10327 - RNA, 18 nt, artificial
  Chemically synthesized
agacuguaaucaagaacc

SEQ ID NO: 10328 - RNA, 18 nt, artificial
  Chemically synthesized
uaccaauuagacaacucc

SEQ ID NO: 10329 - RNA, 18 nt, artificial
  Chemically synthesized
agacauggaaacacaccc

SEQ ID NO: 10330 - RNA, 18 nt, artificial
  Chemically synthesized
accuuugaaacucaagcc

SEQ ID NO: 10331 - RNA, 18 nt, artificial
  Chemically synthesized
ucucaaacagccauagac

SEQ ID NO: 10332 - RNA, 18 nt, artificial
  Chemically synthesized
uuucaaauacacacagcc

SEQ ID NO: 10333 - RNA, 18 nt, artificial
  Chemically synthesized
uuuccuuaggaauuagcc

SEQ ID NO: 10334 - RNA, 18 nt, artificial
  Chemically synthesized
auucguucaacuuccacc

SEQ ID NO: 10335 - RNA, 18 nt, artificial
  Chemically synthesized
uacuuugaaucuuguugc

SEQ ID NO: 10336 - RNA, 18 nt, artificial
  Chemically synthesized
aauuguccaugauaagac

SEQ ID NO: 10337 - RNA, 18 nt, artificial
  Chemically synthesized
auuugauguagaacccgc

SEQ ID NO: 10338 - RNA, 18 nt, artificial
  Chemically synthesized
acuggugucuucucuucc

SEQ ID NO: 10339 - RNA, 18 nt, artificial
  Chemically synthesized
aaccuuugaaacucaagc

SEQ ID NO: 10340 - RNA, 18 nt, artificial
  Chemically synthesized
gaugcuagauuugucucc

SEQ ID NO: 10341 - RNA, 18 nt, artificial
  Chemically synthesized
aacucaucucaaacagcc

SEQ ID NO: 10342 - RNA, 18 nt, artificial
  Chemically synthesized
aaacagcaauguauacuc

SEQ ID NO: 10343 - RNA, 18 nt, artificial
  Chemically synthesized
uugucuggauuucacacc

SEQ ID NO: 10344 - RNA, 18 nt, artificial
  Chemically synthesized
ucauuucucccuuccucc

SEQ ID NO: 10345 - RNA, 18 nt, artificial
  Chemically synthesized
aaacagccauagacaucc

SEQ ID NO: 10346 - RNA, 18 nt, artificial
  Chemically synthesized
aaacugccaggucugagc

SEQ ID NO: 10347 - RNA, 18 nt, artificial
  Chemically synthesized
uugguugaaaugcccacc

SEQ ID NO: 10348 - RNA, 18 nt, artificial
  Chemically synthesized
aauacugaaaacucacuc

SEQ ID NO: 10349 - RNA, 18 nt, artificial
  Chemically synthesized
aagaguagagaacucauc

SEQ ID NO: 10350 - RNA, 18 nt, artificial
  Chemically synthesized
aucauagauguuuucacc

SEQ ID NO: 10351 - RNA, 18 nt, artificial
  Chemically synthesized
gaucuagaaacucaaggc

SEQ ID NO: 10352 - RNA, 18 nt, artificial
  Chemically synthesized
ugaguugguugaaaugcc

SEQ ID NO: 10353 - RNA, 18 nt, artificial
  Chemically synthesized
uagauuugucuccacagc

SEQ ID NO: 10354 - RNA, 18 nt, artificial
  Chemically synthesized
ucuucagauagauguugc

SEQ ID NO: 10355 - RNA, 18 nt, artificial
  Chemically synthesized
ugagugauaggaauacug

SEQ ID NO: 10356 - RNA, 18 nt, artificial
  Chemically synthesized
uccauugcaggaaacucu

SEQ ID NO: 10357 - RNA, 18 nt, artificial
  Chemically synthesized
ucuagagcagauuuguca

SEQ ID NO: 10358 - RNA, 18 nt, artificial
  Chemically synthesized
agaucuagaaacucaagg

SEQ ID NO: 10359 - RNA, 18 nt, artificial
  Chemically synthesized
uuagaagaagaaaacgcc

SEQ ID NO: 10360 - RNA, 18 nt, artificial
  Chemically synthesized
uagagagguggcuuaggc

SEQ ID NO: 10361 - RNA, 18 nt, artificial
  Chemically synthesized
ucacccuuagcauaaggc

SEQ ID NO: 10362 - RNA, 18 nt, artificial
  Chemically synthesized
ucuucuccaccuucugca

SEQ ID NO: 10363 - RNA, 18 nt, artificial
  Chemically synthesized
aagucucuguagugaagg

SEQ ID NO: 10364 - RNA, 18 nt, artificial
  Chemically synthesized
uugaguagauaacaaagg

SEQ ID NO: 10365 - RNA, 18 nt, artificial
  Chemically synthesized
uauuuccucauuucuccc

SEQ ID NO: 10366 - RNA, 18 nt, artificial
  Chemically synthesized
auuugucuccacagccac

SEQ ID NO: 10367 - RNA, 18 nt, artificial
  Chemically synthesized
auuaugugauugagacug

SEQ ID NO: 10368 - RNA, 18 nt, artificial
  Chemically synthesized
uuugucuccacagccacc

SEQ ID NO: 10369 - RNA, 18 nt, artificial
  Chemically synthesized
aagcggaaauuuucuucc

SEQ ID NO: 10370 - RNA, 18 nt, artificial
  Chemically synthesized
acagcaauguauacuccc

SEQ ID NO: 10371 - RNA, 18 nt, artificial
  Chemically synthesized
uauaaucacacucucuuc

SEQ ID NO: 10372 - RNA, 18 nt, artificial
  Chemically synthesized
aauaaagucucuguagug

SEQ ID NO: 10373 - RNA, 18 nt, artificial
  Chemically synthesized
aaaaauagaacaugcucg

SEQ ID NO: 10374 - RNA, 18 nt, artificial
  Chemically synthesized
gaaguucucuagagaugc

SEQ ID NO: 10375 - RNA, 18 nt, artificial
  Chemically synthesized
auuggauaagauugugag

SEQ ID NO: 10376 - RNA, 18 nt, artificial
  Chemically synthesized
cuauuuccucauuucucc

SEQ ID NO: 10377 - RNA, 18 nt, artificial
  Chemically synthesized
uguagaacccgcaagucu

SEQ ID NO: 10378 - RNA, 18 nt, artificial
  Chemically synthesized
agaacucaucucaaacag

SEQ ID NO: 10379 - RNA, 18 nt, artificial
  Chemically synthesized
auagauguugcuuccugc

SEQ ID NO: 10380 - RNA, 18 nt, artificial
  Chemically synthesized
guuagaagaagaaaacgc

SEQ ID NO: 10381 - RNA, 18 nt, artificial
  Chemically synthesized
uuucuacugagaucuaga

SEQ ID NO: 10382 - RNA, 18 nt, artificial
  Chemically synthesized
caucuugcaucaggagcc

SEQ ID NO: 10383 - RNA, 18 nt, artificial
  Chemically synthesized
uuguugcuggaaaggucc

SEQ ID NO: 10384 - RNA, 18 nt, artificial
  Chemically synthesized
uuucuggucucacgcagg

SEQ ID NO: 10385 - RNA, 18 nt, artificial
  Chemically synthesized
uugaaagcaacucuggug

SEQ ID NO: 10386 - RNA, 18 nt, artificial
  Chemically synthesized
uuugauguagaacccgca

SEQ ID NO: 10387 - RNA, 18 nt, artificial
  Chemically synthesized
agagguccaucaaacauc

SEQ ID NO: 10388 - RNA, 18 nt, artificial
  Chemically synthesized
uaggaauacugaaaacuc

SEQ ID NO: 10389 - RNA, 18 nt, artificial
  Chemically synthesized
augauaagaccaggaagc

SEQ ID NO: 10390 - RNA, 18 nt, artificial
  Chemically synthesized
accauggaauuacucacc

SEQ ID NO: 10391 - RNA, 18 nt, artificial
  Chemically synthesized
agugcucuagauugguca

SEQ ID NO: 10392 - RNA, 18 nt, artificial
  Chemically synthesized
ugcccaccuggaagacuc

SEQ ID NO: 10393 - RNA, 18 nt, artificial
  Chemically synthesized
auuguccaugauaagacc

SEQ ID NO: 10394 - RNA, 18 nt, artificial
  Chemically synthesized
aaaccuucauggaugaug

SEQ ID NO: 10395 - RNA, 18 nt, artificial
  Chemically synthesized
gagaugcuagauuugucu

SEQ ID NO: 10396 - RNA, 18 nt, artificial
  Chemically synthesized
aggagaggaaguuagaag

SEQ ID NO: 10397 - RNA, 18 nt, artificial
  Chemically synthesized
aaguaagccuuuugagag

SEQ ID NO: 10398 - RNA, 18 nt, artificial
  Chemically synthesized
uaaucaagaaccuggagg

SEQ ID NO: 10399 - RNA, 18 nt, artificial
  Chemically synthesized
uagauguugcuuccugcc

SEQ ID NO: 10400 - RNA, 18 nt, artificial
  Chemically synthesized
cuaauucuaaauguugcc

SEQ ID NO: 10401 - RNA, 18 nt, artificial
  Chemically synthesized
acuuugagaacagcaacc

SEQ ID NO: 10402 - RNA, 18 nt, artificial
  Chemically synthesized
augcuagauuugucucca

SEQ ID NO: 10403 - RNA, 18 nt, artificial
  Chemically synthesized
auucucccagaaccaaac

SEQ ID NO: 10404 - RNA, 18 nt, artificial
  Chemically synthesized
uuuucaagacuucgagac

SEQ ID NO: 10405 - RNA, 18 nt, artificial
  Chemically synthesized
auuacucacccuuagcau

SEQ ID NO: 10406 - RNA, 18 nt, artificial
  Chemically synthesized
uguauucaaagcaguucu

SEQ ID NO: 10407 - RNA, 18 nt, artificial
  Chemically synthesized
cuuauagaccagaacugc

SEQ ID NO: 10408 - RNA, 18 nt, artificial
  Chemically synthesized
ucaauaauaucaucgagg

SEQ ID NO: 10409 - RNA, 18 nt, artificial
  Chemically synthesized
auuucuaaauucucccag

SEQ ID NO: 10410 - RNA, 18 nt, artificial
  Chemically synthesized
uggauuccaugauuuacc

SEQ ID NO: 10411 - RNA, 18 nt, artificial
  Chemically synthesized
uuuccauucaaaagacuc

SEQ ID NO: 10412 - RNA, 18 nt, artificial
  Chemically synthesized
aauuacucacccuuagca

SEQ ID NO: 10413 - RNA, 18 nt, artificial
  Chemically synthesized
caauguauacucccugcc

SEQ ID NO: 10414 - RNA, 18 nt, artificial
  Chemically synthesized
uuucuguuuucucugucu

SEQ ID NO: 10415 - RNA, 18 nt, artificial
  Chemically synthesized
aaacucaaggcuugguag

SEQ ID NO: 10416 - RNA, 18 nt, artificial
  Chemically synthesized
cuugguagaucaacuucu

SEQ ID NO: 10417 - RNA, 18 nt, artificial
  Chemically synthesized
aguagagaacucaucuca

SEQ ID NO: 10418 - RNA, 18 nt, artificial
  Chemically synthesized
agacuacuguacaagcac

SEQ ID NO: 10419 - RNA, 18 nt, artificial
  Chemically synthesized
ggcauuugauguagaacc

SEQ ID NO: 10420 - RNA, 18 nt, artificial
  Chemically synthesized
uggacuucuaaaccagcc

SEQ ID NO: 10421 - RNA, 18 nt, artificial
  Chemically synthesized
guuccuugacugaguugg

SEQ ID NO: 10422 - RNA, 18 nt, artificial
  Chemically synthesized
uuuaguaccugaagacug

SEQ ID NO: 10423 - RNA, 18 nt, artificial
  Chemically synthesized
ucuucucuuccucgagcc

SEQ ID NO: 10424 - RNA, 18 nt, artificial
  Chemically synthesized
acuuauagaccagaacug

SEQ ID NO: 10425 - RNA, 18 nt, artificial
  Chemically synthesized
uuauaaggaaacguaucc

SEQ ID NO: 10426 - RNA, 18 nt, artificial
  Chemically synthesized
caacaaucaccuuucggc

SEQ ID NO: 10427 - RNA, 18 nt, artificial
  Chemically synthesized
aucuagaaacucaaggcu

SEQ ID NO: 10428 - RNA, 18 nt, artificial
  Chemically synthesized
uauucaaagcaguucugg

SEQ ID NO: 10429 - RNA, 18 nt, artificial
  Chemically synthesized
uaccuucacacguaguuc

SEQ ID NO: 10430 - RNA, 18 nt, artificial
  Chemically synthesized
ugauauuagcuuauaggc

SEQ ID NO: 10431 - RNA, 18 nt, artificial
  Chemically synthesized
agacuucgagacuggaca

SEQ ID NO: 10432 - RNA, 18 nt, artificial
  Chemically synthesized
agcuuucuggucucacgc

SEQ ID NO: 10433 - RNA, 18 nt, artificial
  Chemically synthesized
gaauuacucacccuuagc

SEQ ID NO: 10434 - RNA, 18 nt, artificial
  Chemically synthesized
aauauuaagguagagagg

SEQ ID NO: 10435 - RNA, 18 nt, artificial
  Chemically synthesized
aggcuugguagaucaacu

SEQ ID NO: 10436 - RNA, 18 nt, artificial
  Chemically synthesized
uuggaaugcuggaaaucc

SEQ ID NO: 10437 - RNA, 18 nt, artificial
  Chemically synthesized
agaugcuagauuugucuc

SEQ ID NO: 10438 - RNA, 18 nt, artificial
  Chemically synthesized
uucaaucacccuagaccu

SEQ ID NO: 10439 - RNA, 18 nt, artificial
  Chemically synthesized
ugaguuaaaugcuguugg

SEQ ID NO: 10440 - RNA, 18 nt, artificial
  Chemically synthesized
uugguagaucaacuucug

SEQ ID NO: 10441 - RNA, 18 nt, artificial
  Chemically synthesized
uuugaaucuuguugcugg

SEQ ID NO: 10442 - RNA, 18 nt, artificial
  Chemically synthesized
uucaaagcaguucugggc

SEQ ID NO: 10443 - RNA, 18 nt, artificial
  Chemically synthesized
auccauugcaggaaacuc

SEQ ID NO: 10444 - RNA, 18 nt, artificial
  Chemically synthesized
agaguagagaacucaucu

SEQ ID NO: 10445 - RNA, 18 nt, artificial
  Chemically synthesized
agaaguuugaacucaugg

SEQ ID NO: 10446 - RNA, 18 nt, artificial
  Chemically synthesized
uauguuucuggaaucaag

SEQ ID NO: 10447 - RNA, 18 nt, artificial
  Chemically synthesized
gucuccagaagaugugcc

SEQ ID NO: 10448 - RNA, 18 nt, artificial
  Chemically synthesized
cucaaaccaaacacacuc

SEQ ID NO: 10449 - RNA, 18 nt, artificial
  Chemically synthesized
uacugagaucuagaaacu

SEQ ID NO: 10450 - RNA, 18 nt, artificial
  Chemically synthesized
ucauuaugugauugagac

SEQ ID NO: 10451 - RNA, 18 nt, artificial
  Chemically synthesized
ucucuuuugucacaggag

SEQ ID NO: 10452 - RNA, 18 nt, artificial
  Chemically synthesized
aagcaaagucauucugag

SEQ ID NO: 10453 - RNA, 18 nt, artificial
  Chemically synthesized
ucucuuucuguuuucucu

SEQ ID NO: 10454 - RNA, 18 nt, artificial
  Chemically synthesized
gucugugcaauaaauacu

SEQ ID NO: 10455 - RNA, 18 nt, artificial
  Chemically synthesized
gaaggucaaguuucucag

SEQ ID NO: 10456 - RNA, 18 nt, artificial
  Chemically synthesized
aaacacucaguaacaaac

SEQ ID NO: 10457 - RNA, 18 nt, artificial
  Chemically synthesized
acaaguacaagcaaaguc

SEQ ID NO: 10458 - RNA, 18 nt, artificial
  Chemically synthesized
aaguuucucagcucugug

SEQ ID NO: 10459 - RNA, 18 nt, artificial
  Chemically synthesized
uuccuugaaaaauagugg

SEQ ID NO: 10460 - RNA, 18 nt, artificial
  Chemically synthesized
cucccagggcuaaacucu

SEQ ID NO: 10461 - RNA, 18 nt, artificial
  Chemically synthesized
ucuccacagccaccagcu

SEQ ID NO: 10462 - RNA, 18 nt, artificial
  Chemically synthesized
auuccaugauuuaccauc

SEQ ID NO: 10463 - RNA, 18 nt, artificial
  Chemically synthesized
agggauguucaaucaccc

SEQ ID NO: 10464 - RNA, 18 nt, artificial
  Chemically synthesized
acaccacaacaaucaccu

SEQ ID NO: 10465 - RNA, 18 nt, artificial
  Chemically synthesized
gauacuacaagcacacug

SEQ ID NO: 10466 - RNA, 18 nt, artificial
  Chemically synthesized
agagguccaggaagguca

SEQ ID NO: 10467 - RNA, 18 nt, artificial
  Chemically synthesized
auggaauuacucacccuu

SEQ ID NO: 10468 - RNA, 18 nt, artificial
  Chemically synthesized
ugauagggauacauaggg

SEQ ID NO: 10469 - RNA, 18 nt, artificial
  Chemically synthesized
uggcucauauuuaguacc

SEQ ID NO: 10470 - RNA, 18 nt, artificial
  Chemically synthesized
aagcauaagggauaaggg

SEQ ID NO: 10471 - RNA, 18 nt, artificial
  Chemically synthesized
agauguucuaguuguucu

SEQ ID NO: 10472 - RNA, 18 nt, artificial
  Chemically synthesized
acuccagguaaguguucc

SEQ ID NO: 10473 - RNA, 18 nt, artificial
  Chemically synthesized
uccuugagauuagcagcc

SEQ ID NO: 10474 - RNA, 18 nt, artificial
  Chemically synthesized
aaugaagaugauaccagc

SEQ ID NO: 10475 - RNA, 18 nt, artificial
  Chemically synthesized
gacugcucagaaacugcc

SEQ ID NO: 10476 - RNA, 18 nt, artificial
  Chemically synthesized
gaguagagaacucaucuc

SEQ ID NO: 10477 - RNA, 18 nt, artificial
  Chemically synthesized
aggucuaaagagagauug

SEQ ID NO: 10478 - RNA, 18 nt, artificial
  Chemically synthesized
uugcuuccugccaauugc

SEQ ID NO: 10479 - RNA, 18 nt, artificial
  Chemically synthesized
aagugcucuagauugguc

SEQ ID NO: 10480 - RNA, 18 nt, artificial
  Chemically synthesized
auuagacaacucccuauu

SEQ ID NO: 10481 - RNA, 18 nt, artificial
  Chemically synthesized
uucacacguaguucuccu

SEQ ID NO: 10482 - RNA, 18 nt, artificial
  Chemically synthesized
cuucuguaaacuugauag

SEQ ID NO: 10483 - RNA, 18 nt, artificial
  Chemically synthesized
uagucacacucaccaggg

SEQ ID NO: 10484 - RNA, 18 nt, artificial
  Chemically synthesized
accuuagcauucuggacu

SEQ ID NO: 10485 - RNA, 18 nt, artificial
  Chemically synthesized
caucauagauguuuucac

SEQ ID NO: 10486 - RNA, 18 nt, artificial
  Chemically synthesized
caccauggaauuacucac

SEQ ID NO: 10487 - RNA, 18 nt, artificial
  Chemically synthesized
uugcaggaaacucuggug

SEQ ID NO: 10488 - RNA, 18 nt, artificial
  Chemically synthesized
augauggucuuauucauc

SEQ ID NO: 10489 - RNA, 18 nt, artificial
  Chemically synthesized
uuggauaaaguucauagg

SEQ ID NO: 10490 - RNA, 18 nt, artificial
  Chemically synthesized
auaugugcacaaaugcac

SEQ ID NO: 10491 - RNA, 18 nt, artificial
  Chemically synthesized
gaggcuggaugaacauuc

SEQ ID NO: 10492 - RNA, 18 nt, artificial
  Chemically synthesized
gaacucaucucaaacagc

SEQ ID NO: 10493 - RNA, 18 nt, artificial
  Chemically synthesized
agaacaaugucucuuucu

SEQ ID NO: 10494 - RNA, 18 nt, artificial
  Chemically synthesized
aaagauacaccagcggcu

SEQ ID NO: 10495 - RNA, 18 nt, artificial
  Chemically synthesized
uuauagaccagaacugcu

SEQ ID NO: 10496 - RNA, 18 nt, artificial
  Chemically synthesized
acacuuucaaauacacac

SEQ ID NO: 10497 - RNA, 18 nt, artificial
  Chemically synthesized
aauugucuggauuucaca

SEQ ID NO: 10498 - RNA, 18 nt, artificial
  Chemically synthesized
uuaauuccagacacauug

SEQ ID NO: 10499 - RNA, 18 nt, artificial
  Chemically synthesized
ucaaaacuaccaaaaugg

SEQ ID NO: 10500 - RNA, 18 nt, artificial
  Chemically synthesized
accuucuuuauaagaacc

SEQ ID NO: 10501 - RNA, 18 nt, artificial
  Chemically synthesized
uucagagguccaucaaac

SEQ ID NO: 10502 - RNA, 18 nt, artificial
  Chemically synthesized
ugcuaaucggaauucuuc

SEQ ID NO: 10503 - RNA, 18 nt, artificial
  Chemically synthesized
aucggaauucuucaaugg

SEQ ID NO: 10504 - RNA, 18 nt, artificial
  Chemically synthesized
uuccuucuggauuccaug

SEQ ID NO: 10505 - RNA, 18 nt, artificial
  Chemically synthesized
agcacgucuuaaacaacc

SEQ ID NO: 10506 - RNA, 18 nt, artificial
  Chemically synthesized
agucugugcaauaaauac

SEQ ID NO: 10507 - RNA, 18 nt, artificial
  Chemically synthesized
aaugugggaaacugucca

SEQ ID NO: 10508 - RNA, 18 nt, artificial
  Chemically synthesized
uucugaaaaagcauuccc

SEQ ID NO: 10509 - RNA, 18 nt, artificial
  Chemically synthesized
aauguucuguuucugagg

SEQ ID NO: 10510 - RNA, 18 nt, artificial
  Chemically synthesized
uccuguacccacuguucc

SEQ ID NO: 10511 - RNA, 18 nt, artificial
  Chemically synthesized
ugauauucaaacucagca

SEQ ID NO: 10512 - RNA, 18 nt, artificial
  Chemically synthesized
ugauugagacuguaauca

SEQ ID NO: 10513 - RNA, 18 nt, artificial
  Chemically synthesized
uucuaaauguugccaucc

SEQ ID NO: 10514 - RNA, 18 nt, artificial
  Chemically synthesized
ccaauuagacaacucccu

SEQ ID NO: 10515 - RNA, 18 nt, artificial
  Chemically synthesized
gauauuugaagcacgucu

SEQ ID NO: 10516 - RNA, 18 nt, artificial
  Chemically synthesized
ucuuauucaucugacagg

SEQ ID NO: 10517 - RNA, 18 nt, artificial
  Chemically synthesized
aauacuuuaggcugguug

SEQ ID NO: 10518 - RNA, 18 nt, artificial
  Chemically synthesized
uaauaacaccauugaagc

SEQ ID NO: 10519 - RNA, 18 nt, artificial
  Chemically synthesized
uaacaaacacuucugacu

SEQ ID NO: 10520 - RNA, 18 nt, artificial
  Chemically synthesized
ucuagaaacucaaggcuu

SEQ ID NO: 10521 - RNA, 18 nt, artificial
  Chemically synthesized
uaugcuaaucggaauucu

SEQ ID NO: 10522 - RNA, 18 nt, artificial
  Chemically synthesized
auaugaucaugcggacac

SEQ ID NO: 10523 - RNA, 18 nt, artificial
  Chemically synthesized
cuagcucauuccuuaccc

SEQ ID NO: 10524 - RNA, 18 nt, artificial
  Chemically synthesized
auagucacacucaccagg

SEQ ID NO: 10525 - RNA, 18 nt, artificial
  Chemically synthesized
aagcucagaucuaaauac

SEQ ID NO: 10526 - RNA, 18 nt, artificial
  Chemically synthesized
aguguuggacccagcugg

SEQ ID NO: 10527 - RNA, 18 nt, artificial
  Chemically synthesized
uucgagacuggacaagcc

SEQ ID NO: 10528 - RNA, 18 nt, artificial
  Chemically synthesized
auugagacuguaaucaag

SEQ ID NO: 10529 - RNA, 18 nt, artificial
  Chemically synthesized
acacucucuucuauacag

SEQ ID NO: 10530 - RNA, 18 nt, artificial
  Chemically synthesized
auugcaggaaacucuggu

SEQ ID NO: 10531 - RNA, 18 nt, artificial
  Chemically synthesized
augucaagguaaaugagg

SEQ ID NO: 10532 - RNA, 18 nt, artificial
  Chemically synthesized
auaauaucaucgagguag

SEQ ID NO: 10533 - RNA, 18 nt, artificial
  Chemically synthesized
uucaaacucagcacaggc

SEQ ID NO: 10534 - RNA, 18 nt, artificial
  Chemically synthesized
gucuaaguaugcuaaucg

SEQ ID NO: 10535 - RNA, 18 nt, artificial
  Chemically synthesized
uuccugccaauugcaucc

SEQ ID NO: 10536 - RNA, 18 nt, artificial
  Chemically synthesized
cuagauuugucuccacag

SEQ ID NO: 10537 - RNA, 18 nt, artificial
  Chemically synthesized
uguucuaguuguucuaag

SEQ ID NO: 10538 - RNA, 18 nt, artificial
  Chemically synthesized
agaacugcuacaacagau

SEQ ID NO: 10539 - RNA, 18 nt, artificial
  Chemically synthesized
guucucuagagaugcuag

SEQ ID NO: 10540 - RNA, 18 nt, artificial
  Chemically synthesized
auaucuagugcaccaugg

SEQ ID NO: 10541 - RNA, 18 nt, artificial
  Chemically synthesized
aacuguccaaauuuacag

SEQ ID NO: 10542 - RNA, 18 nt, artificial
  Chemically synthesized
auugucuggauuucacac

SEQ ID NO: 10543 - RNA, 18 nt, artificial
  Chemically synthesized
ugcacuggaagcuccuug

SEQ ID NO: 10544 - RNA, 18 nt, artificial
  Chemically synthesized
uuuguuggaagugaaagu

SEQ ID NO: 10545 - RNA, 18 nt, artificial
  Chemically synthesized
gauuugucaaacuuuucc

SEQ ID NO: 10546 - RNA, 18 nt, artificial
  Chemically synthesized
aauggucaaauugcacag

SEQ ID NO: 10547 - RNA, 18 nt, artificial
  Chemically synthesized
uggaaagaauugccagcc

SEQ ID NO: 10548 - RNA, 18 nt, artificial
  Chemically synthesized
aacagcaauguauacucc

SEQ ID NO: 10549 - RNA, 18 nt, artificial
  Chemically synthesized
cucugugaagauaucugg

SEQ ID NO: 10550 - RNA, 18 nt, artificial
  Chemically synthesized
aaaauaaacuucugcugc

SEQ ID NO: 10551 - RNA, 18 nt, artificial
  Chemically synthesized
aucccacuuccuuccugc

SEQ ID NO: 10552 - RNA, 18 nt, artificial
  Chemically synthesized
gaacuuauagaccagaac

SEQ ID NO: 10553 - RNA, 18 nt, artificial
  Chemically synthesized
cucugcacuggaagcucc

SEQ ID NO: 10554 - RNA, 18 nt, artificial
  Chemically synthesized
cagccaucugugucuccc

SEQ ID NO: 10555 - RNA, 18 nt, artificial
  Chemically synthesized
auauuaagguagagaggu

SEQ ID NO: 10556 - RNA, 18 nt, artificial
  Chemically synthesized
auuugaguuucaaugugg

SEQ ID NO: 10557 - RNA, 18 nt, artificial
  Chemically synthesized
agaaggcgguacagcucc

SEQ ID NO: 10558 - RNA, 18 nt, artificial
  Chemically synthesized
uucuaaaccagccagacc

SEQ ID NO: 10559 - RNA, 18 nt, artificial
  Chemically synthesized
uuucaaugugggaaacug

SEQ ID NO: 10560 - RNA, 18 nt, artificial
  Chemically synthesized
gcauuugauguagaaccc

SEQ ID NO: 10561 - RNA, 18 nt, artificial
  Chemically synthesized
uagaaacucaaggcuugg

SEQ ID NO: 10562 - RNA, 18 nt, artificial
  Chemically synthesized
gacucuguauuuuagucu

SEQ ID NO: 10563 - RNA, 18 nt, artificial
  Chemically synthesized
cuccuugagauuagcagc

SEQ ID NO: 10564 - RNA, 18 nt, artificial
  Chemically synthesized
ugagcagggucuucucca

SEQ ID NO: 10565 - RNA, 18 nt, artificial
  Chemically synthesized
auacuacaagcacacuga

SEQ ID NO: 10566 - RNA, 18 nt, artificial
  Chemically synthesized
ucucuguagugaaggcag

SEQ ID NO: 10567 - RNA, 18 nt, artificial
  Chemically synthesized
guuggauaaaguucauag

SEQ ID NO: 10568 - RNA, 18 nt, artificial
  Chemically synthesized
auaacauccacucuuccc

SEQ ID NO: 10569 - RNA, 18 nt, artificial
  Chemically synthesized
agggcuaaacucuggaug

SEQ ID NO: 10570 - RNA, 18 nt, artificial
  Chemically synthesized
gucuucuccaccuucugc

SEQ ID NO: 10571 - RNA, 18 nt, artificial
  Chemically synthesized
agcagggucuucuccacc

SEQ ID NO: 10572 - RNA, 18 nt, artificial
  Chemically synthesized
auguuggcagcaauggcc

SEQ ID NO: 10573 - RNA, 18 nt, artificial
  Chemically synthesized
aauuagacaacucccuau

SEQ ID NO: 10574 - RNA, 18 nt, artificial
  Chemically synthesized
auaagaccaggaagcgga

SEQ ID NO: 10575 - RNA, 18 nt, artificial
  Chemically synthesized
ucauggguuccuugacug

SEQ ID NO: 10576 - RNA, 18 nt, artificial
  Chemically synthesized
auacauagggauaugugc

SEQ ID NO: 10577 - RNA, 18 nt, artificial
  Chemically synthesized
aauagucacacucaccag

SEQ ID NO: 10578 - RNA, 18 nt, artificial
  Chemically synthesized
uuccuuccugccucuagc

SEQ ID NO: 10579 - RNA, 18 nt, artificial
  Chemically synthesized
aaacuuuuccaaguuucc

SEQ ID NO: 10580 - RNA, 18 nt, artificial
  Chemically synthesized
auggauguauucuucaag

SEQ ID NO: 10581 - RNA, 18 nt, artificial
  Chemically synthesized
acucaagccauuucuacu

SEQ ID NO: 10582 - RNA, 18 nt, artificial
  Chemically synthesized
uggucuuauucaucugac

SEQ ID NO: 10583 - RNA, 18 nt, artificial
  Chemically synthesized
aucaaacaucacuuguuc

SEQ ID NO: 10584 - RNA, 18 nt, artificial
  Chemically synthesized
auugguguauucaaagca

SEQ ID NO: 10585 - RNA, 18 nt, artificial
  Chemically synthesized
ucugaaacacucaguaac

SEQ ID NO: 10586 - RNA, 18 nt, artificial
  Chemically synthesized
auucuggacuuuuguuuc

SEQ ID NO: 10587 - RNA, 18 nt, artificial
  Chemically synthesized
ugaacacccaguucaguc

SEQ ID NO: 10588 - RNA, 18 nt, artificial
  Chemically synthesized
aucgagugacaaagugac

SEQ ID NO: 10589 - RNA, 18 nt, artificial
  Chemically synthesized
ucuccagaagaugugccg

SEQ ID NO: 10590 - RNA, 18 nt, artificial
  Chemically synthesized
guacaagcaaagucauuc

SEQ ID NO: 10591 - RNA, 18 nt, artificial
  Chemically synthesized
cagcaaccuuugaaacuc

SEQ ID NO: 10592 - RNA, 18 nt, artificial
  Chemically synthesized
ucaggugaaaauagaacu

SEQ ID NO: 10593 - RNA, 18 nt, artificial
  Chemically synthesized
aaggcuugguagaucaac

SEQ ID NO: 10594 - RNA, 18 nt, artificial
  Chemically synthesized
uuuugagauguccaaugg

SEQ ID NO: 10595 - RNA, 18 nt, artificial
  Chemically synthesized
auuucuacugagaucuag

SEQ ID NO: 10596 - RNA, 18 nt, artificial
  Chemically synthesized
aggaaaaagugaacaccc

SEQ ID NO: 10597 - RNA, 18 nt, artificial
  Chemically synthesized
acacaccaaugauggucu

SEQ ID NO: 10598 - RNA, 18 nt, artificial
  Chemically synthesized
agaguugaaaugacuuuc

SEQ ID NO: 10599 - RNA, 18 nt, artificial
  Chemically synthesized
ugagccacauuaaguucu

SEQ ID NO: 10600 - RNA, 18 nt, artificial
  Chemically synthesized
auguagaacccgcaaguc

SEQ ID NO: 10601 - RNA, 18 nt, artificial
  Chemically synthesized
gaaugaccaggaugguug

SEQ ID NO: 10602 - RNA, 18 nt, artificial
  Chemically synthesized
uggaaauccagauguucu

SEQ ID NO: 10603 - RNA, 18 nt, artificial
  Chemically synthesized
acccagggauguucaauc

SEQ ID NO: 10604 - RNA, 18 nt, artificial
  Chemically synthesized
cagccagcaagaagcauc

SEQ ID NO: 10605 - RNA, 18 nt, artificial
  Chemically synthesized
uauuaagguagagaggug

SEQ ID NO: 10606 - RNA, 18 nt, artificial
  Chemically synthesized
caaugaagaugauaccag

SEQ ID NO: 10607 - RNA, 18 nt, artificial
  Chemically synthesized
cucccugccuugaauacc

SEQ ID NO: 10608 - RNA, 18 nt, artificial
  Chemically synthesized
uucuaguuguucuaagcc

SEQ ID NO: 10609 - RNA, 18 nt, artificial
  Chemically synthesized
uacaagcaaagucauucu

SEQ ID NO: 10610 - RNA, 18 nt, artificial
  Chemically synthesized
agaggaagugaaagcggc

SEQ ID NO: 10611 - RNA, 18 nt, artificial
  Chemically synthesized
acacuucugacugugguc

SEQ ID NO: 10612 - RNA, 18 nt, artificial
  Chemically synthesized
ccauggaauuacucaccc

SEQ ID NO: 10613 - RNA, 18 nt, artificial
  Chemically synthesized
acuguuccuucuggauuc

SEQ ID NO: 10614 - RNA, 18 nt, artificial
  Chemically synthesized
ugcuagauuugucuccac

SEQ ID NO: 10615 - RNA, 18 nt, artificial
  Chemically synthesized
uacaugagacauggaaac

SEQ ID NO: 10616 - RNA, 18 nt, artificial
  Chemically synthesized
auucuaaauguugccauc

SEQ ID NO: 10617 - RNA, 18 nt, artificial
  Chemically synthesized
acucuucccaaaaugugg

SEQ ID NO: 10618 - RNA, 18 nt, artificial
  Chemically synthesized
caaccuuugaaacucaag

SEQ ID NO: 10619 - RNA, 18 nt, artificial
  Chemically synthesized
uaaauucucccagaacca

SEQ ID NO: 10620 - RNA, 18 nt, artificial
  Chemically synthesized
uaaagucucuguagugaa

SEQ ID NO: 10621 - RNA, 18 nt, artificial
  Chemically synthesized
agaccuugaauacaaguu

SEQ ID NO: 10622 - RNA, 18 nt, artificial
  Chemically synthesized
gagauuugaguuucaaug

SEQ ID NO: 10623 - RNA, 18 nt, artificial
  Chemically synthesized
acaccuccacgcagggcu

SEQ ID NO: 10624 - RNA, 18 nt, artificial
  Chemically synthesized
guucugggcuaaagggug

SEQ ID NO: 10625 - RNA, 18 nt, artificial
  Chemically synthesized
gacaaugaagaugauacc

SEQ ID NO: 10626 - RNA, 18 nt, artificial
  Chemically synthesized
aaacacuucugacugugg

SEQ ID NO: 10627 - RNA, 18 nt, artificial
  Chemically synthesized
aaagugacagaguguacu

SEQ ID NO: 10628 - RNA, 18 nt, artificial
  Chemically synthesized
aagucagcuuaugaagcc

SEQ ID NO: 10629 - RNA, 18 nt, artificial
  Chemically synthesized
guucagacacuuauaagg

SEQ ID NO: 10630 - RNA, 18 nt, artificial
  Chemically synthesized
uugugagccacauuaagu

SEQ ID NO: 10631 - RNA, 18 nt, artificial
  Chemically synthesized
caggugauauucaaacuc

SEQ ID NO: 10632 - RNA, 18 nt, artificial
  Chemically synthesized
uauucaaagauacaccag

SEQ ID NO: 10633 - RNA, 18 nt, artificial
  Chemically synthesized
ggacaaugaagaugauac

SEQ ID NO: 10634 - RNA, 18 nt, artificial
  Chemically synthesized
augucucuuucuguuuuc

SEQ ID NO: 10635 - RNA, 18 nt, artificial
  Chemically synthesized
ucuggauuucacaccucc

SEQ ID NO: 10636 - RNA, 18 nt, artificial
  Chemically synthesized
uaucaucgagguaguagu

SEQ ID NO: 10637 - RNA, 18 nt, artificial
  Chemically synthesized
uuucaaauuggaaugcug

SEQ ID NO: 10638 - RNA, 18 nt, artificial
  Chemically synthesized
aagacucaggaaaagaac

SEQ ID NO: 10639 - RNA, 18 nt, artificial
  Chemically synthesized
aaggaaaaagugaacacc

SEQ ID NO: 10640 - RNA, 18 nt, artificial
  Chemically synthesized
cucuagagcagauuuguc

SEQ ID NO: 10641 - RNA, 18 nt, artificial
  Chemically synthesized
uacuguacaagcacaaga

SEQ ID NO: 10642 - RNA, 18 nt, artificial
  Chemically synthesized
cuuaggcucugauaugcc

SEQ ID NO: 10643 - RNA, 18 nt, artificial
  Chemically synthesized
cuuccuugaaaaauagug

SEQ ID NO: 10644 - RNA, 18 nt, artificial
  Chemically synthesized
cuuccaccaagagcugcc

SEQ ID NO: 10645 - RNA, 18 nt, artificial
  Chemically synthesized
uagaccagaacugcuaca

SEQ ID NO: 10646 - RNA, 18 nt, artificial
  Chemically synthesized
uauuuaguaccugaagac

SEQ ID NO: 10647 - RNA, 18 nt, artificial
  Chemically synthesized
uugagacuguaaucaaga

SEQ ID NO: 10648 - RNA, 18 nt, artificial
  Chemically synthesized
aauagaacaugcucgaga

SEQ ID NO: 10649 - RNA, 18 nt, artificial
  Chemically synthesized
cucaagccauuucuacug

SEQ ID NO: 10650 - RNA, 18 nt, artificial
  Chemically synthesized
cuucacacguaguucucc

SEQ ID NO: 10651 - RNA, 18 nt, artificial
  Chemically synthesized
ugacuuucuuugucaugg

SEQ ID NO: 10652 - RNA, 18 nt, artificial
  Chemically synthesized
cuguaaucaagaaccugg

SEQ ID NO: 10653 - RNA, 18 nt, artificial
  Chemically synthesized
cucuagcccaaauugucc

SEQ ID NO: 10654 - RNA, 18 nt, artificial
  Chemically synthesized
aucacuuugagaacagca

SEQ ID NO: 10655 - RNA, 18 nt, artificial
  Chemically synthesized
auugcauccuguacccac

SEQ ID NO: 10656 - RNA, 18 nt, artificial
  Chemically synthesized
ugauggucuuauucaucu

SEQ ID NO: 10657 - RNA, 18 nt, artificial
  Chemically synthesized
uuuucugagucgucucca

SEQ ID NO: 10658 - RNA, 18 nt, artificial
  Chemically synthesized
uuuucaccucuaccauac

SEQ ID NO: 10659 - RNA, 18 nt, artificial
  Chemically synthesized
uuucuuuaaaugcaccug

SEQ ID NO: 10660 - RNA, 18 nt, artificial
  Chemically synthesized
aagauacaccagcggcuc

SEQ ID NO: 10661 - RNA, 18 nt, artificial
  Chemically synthesized
auacugaaaacucacuca

SEQ ID NO: 10662 - RNA, 18 nt, artificial
  Chemically synthesized
agaaagcuagacuacuug

SEQ ID NO: 10663 - RNA, 18 nt, artificial
  Chemically synthesized
ugacuguggucauauuuc

SEQ ID NO: 10664 - RNA, 18 nt, artificial
  Chemically synthesized
ccuugaauaccuucacac

SEQ ID NO: 10665 - RNA, 18 nt, artificial
  Chemically synthesized
uuucuuugucauggguuc

SEQ ID NO: 10666 - RNA, 18 nt, artificial
  Chemically synthesized
agcccaagaaguuugaac

SEQ ID NO: 10667 - RNA, 18 nt, artificial
  Chemically synthesized
ugaacauucuuuucuggg

SEQ ID NO: 10668 - RNA, 18 nt, artificial
  Chemically synthesized
uggugucuucucuuccuc

SEQ ID NO: 10669 - RNA, 18 nt, artificial
  Chemically synthesized
cuucgagacuggacaagc

SEQ ID NO: 10670 - RNA, 18 nt, artificial
  Chemically synthesized
acucaugguaauaacacc

SEQ ID NO: 10671 - RNA, 18 nt, artificial
  Chemically synthesized
aauguauacucccugccu

SEQ ID NO: 10672 - RNA, 18 nt, artificial
  Chemically synthesized
aaaguaagccuuuugaga

SEQ ID NO: 10673 - RNA, 18 nt, artificial
  Chemically synthesized
cuuucaauagucacacuc

SEQ ID NO: 10674 - RNA, 18 nt, artificial
  Chemically synthesized
aaauccagauguucuagu

SEQ ID NO: 10675 - RNA, 18 nt, artificial
  Chemically synthesized
auuccuuacccaguccuc

SEQ ID NO: 10676 - RNA, 18 nt, artificial
  Chemically synthesized
uugaauaccuucacacgu

SEQ ID NO: 10677 - RNA, 18 nt, artificial
  Chemically synthesized
ucagaaacugccaggucu

SEQ ID NO: 10678 - RNA, 18 nt, artificial
  Chemically synthesized
uccaguugacacugagag

SEQ ID NO: 10679 - RNA, 18 nt, artificial
  Chemically synthesized
uaaucacacucucuucua

SEQ ID NO: 10680 - RNA, 18 nt, artificial
  Chemically synthesized
agucucuguagugaaggc

SEQ ID NO: 10681 - RNA, 18 nt, artificial
  Chemically synthesized
aacucaagccauuucuac

SEQ ID NO: 10682 - RNA, 18 nt, artificial
  Chemically synthesized
gaacccgcaagucugugc

SEQ ID NO: 10683 - RNA, 18 nt, artificial
  Chemically synthesized
uacacacagcccugauag

SEQ ID NO: 10684 - RNA, 18 nt, artificial
  Chemically synthesized
ugccauugaaagcaacuc

SEQ ID NO: 10685 - RNA, 18 nt, artificial
  Chemically synthesized
uauucaaacucagcacag

SEQ ID NO: 10686 - RNA, 18 nt, artificial
  Chemically synthesized
ugaacaaguguuggaccc

SEQ ID NO: 10687 - RNA, 18 nt, artificial
  Chemically synthesized
uccagaagaugugccgcc

SEQ ID NO: 10688 - RNA, 18 nt, artificial
  Chemically synthesized
acaagaguagagaacuca

SEQ ID NO: 10689 - RNA, 18 nt, artificial
  Chemically synthesized
cuuuucugagucgucucc

SEQ ID NO: 10690 - RNA, 18 nt, artificial
  Chemically synthesized
auggaaacacacccaggg

SEQ ID NO: 10691 - RNA, 18 nt, artificial
  Chemically synthesized
guguucacaaguacaagc

SEQ ID NO: 10692 - RNA, 18 nt, artificial
  Chemically synthesized
aauugguguauucaaagc

SEQ ID NO: 10693 - RNA, 18 nt, artificial
  Chemically synthesized
aucacacucucuucuaua

SEQ ID NO: 10694 - RNA, 18 nt, artificial
  Chemically synthesized
aagugaacacccaguuca

SEQ ID NO: 10695 - RNA, 18 nt, artificial
  Chemically synthesized
caaguacaagcaaaguca

SEQ ID NO: 10696 - RNA, 18 nt, artificial
  Chemically synthesized
agcaauguauacucccug

SEQ ID NO: 10697 - RNA, 18 nt, artificial
  Chemically synthesized
uuugucauggguuccuug

SEQ ID NO: 10698 - RNA, 18 nt, artificial
  Chemically synthesized
uccuuuucuugaauguuc

SEQ ID NO: 10699 - RNA, 18 nt, artificial
  Chemically synthesized
aagacuucgagacuggac

SEQ ID NO: 10700 - RNA, 18 nt, artificial
  Chemically synthesized
aguggcuaaagaaacagc

SEQ ID NO: 10701 - RNA, 18 nt, artificial
  Chemically synthesized
aaagcuagacuacuugga

SEQ ID NO: 10702 - RNA, 18 nt, artificial
  Chemically synthesized
ugaguaugagaaauguca

SEQ ID NO: 10703 - RNA, 18 nt, artificial
  Chemically synthesized
aucaggugaaaauagaac

SEQ ID NO: 10704 - RNA, 18 nt, artificial
  Chemically synthesized
cuuucuggucucacgcag

SEQ ID NO: 10705 - RNA, 18 nt, artificial
  Chemically synthesized
aaagcauucccaccuuug

SEQ ID NO: 10706 - RNA, 18 nt, artificial
  Chemically synthesized
cuucauggaugauguugg

SEQ ID NO: 10707 - RNA, 18 nt, artificial
  Chemically synthesized
cugucaauauuaagguag

SEQ ID NO: 10708 - RNA, 18 nt, artificial
  Chemically synthesized
cucuucagauagauguug

SEQ ID NO: 10709 - RNA, 18 nt, artificial
  Chemically synthesized
ucccagggcuaaacucug

SEQ ID NO: 10710 - RNA, 18 nt, artificial
  Chemically synthesized
uggucaaauugcacaggc

SEQ ID NO: 10711 - RNA, 18 nt, artificial
  Chemically synthesized
gacaccacaacaaucacc

SEQ ID NO: 10712 - RNA, 18 nt, artificial
  Chemically synthesized
aaaguuuugagaugucca

SEQ ID NO: 10713 - RNA, 18 nt, artificial
  Chemically synthesized
gucuaaagagagauugag

SEQ ID NO: 10714 - RNA, 18 nt, artificial
  Chemically synthesized
ugacaucgagugacaaag

SEQ ID NO: 10715 - RNA, 18 nt, artificial
  Chemically synthesized
uugcuggaaagguccaag

SEQ ID NO: 10716 - RNA, 18 nt, artificial
  Chemically synthesized
ucacacucucuucuauac

SEQ ID NO: 10717 - RNA, 18 nt, artificial
  Chemically synthesized
uucuccaccuucugcagg

SEQ ID NO: 10718 - RNA, 18 nt, artificial
  Chemically synthesized
ccuucuuuauaagaaccc

SEQ ID NO: 10719 - RNA, 18 nt, artificial
  Chemically synthesized
cuuccugccaauugcauc

SEQ ID NO: 10720 - RNA, 18 nt, artificial
  Chemically synthesized
cugagcagggucuucucc

SEQ ID NO: 10721 - RNA, 18 nt, artificial
  Chemically synthesized
ucuguauuuuagucuagc

SEQ ID NO: 10722 - RNA, 18 nt, artificial
  Chemically synthesized
uuccaugauuuaccaucc

SEQ ID NO: 10723 - RNA, 18 nt, artificial
  Chemically synthesized
uugagauuagcagcccug

SEQ ID NO: 10724 - RNA, 18 nt, artificial
  Chemically synthesized
ccaauugcauccuguacc

SEQ ID NO: 10725 - RNA, 18 nt, artificial
  Chemically synthesized
caagcauaagggauaagg

SEQ ID NO: 10726 - RNA, 18 nt, artificial
  Chemically synthesized
uggaaaccuucauggaug

SEQ ID NO: 10727 - RNA, 18 nt, artificial
  Chemically synthesized
agacucuguauuuuaguc

SEQ ID NO: 10728 - RNA, 18 nt, artificial
  Chemically synthesized
cagcuuucuggucucacg

SEQ ID NO: 10729 - RNA, 18 nt, artificial
  Chemically synthesized
cacauuguuuucucaaug

SEQ ID NO: 10730 - RNA, 18 nt, artificial
  Chemically synthesized
guaugagaaaugucaagg

SEQ ID NO: 10731 - RNA, 18 nt, artificial
  Chemically synthesized
uguucaaucacccuagac

SEQ ID NO: 10732 - RNA, 18 nt, artificial
  Chemically synthesized
aucauccuggcaucaucc

SEQ ID NO: 10733 - RNA, 18 nt, artificial
  Chemically synthesized
augcugcuuucaugacag

SEQ ID NO: 10734 - RNA, 18 nt, artificial
  Chemically synthesized
uaaacuucugcugcaacu

SEQ ID NO: 10735 - RNA, 18 nt, artificial
  Chemically synthesized
uugguguauucaaagcag

SEQ ID NO: 10736 - RNA, 18 nt, artificial
  Chemically synthesized
gucuuauucaucugacag

SEQ ID NO: 10737 - RNA, 18 nt, artificial
  Chemically synthesized
acgucuuaaacaaccuua

SEQ ID NO: 10738 - RNA, 18 nt, artificial
  Chemically synthesized
aacuuauagaccagaacu

SEQ ID NO: 10739 - RNA, 18 nt, artificial
  Chemically synthesized
ugaggucaucccacuucc

SEQ ID NO: 10740 - RNA, 18 nt, artificial
  Chemically synthesized
ugggcuaaagggugagag

SEQ ID NO: 10741 - RNA, 18 nt, artificial
  Chemically synthesized
acacguaguucuccuggc

SEQ ID NO: 10742 - RNA, 18 nt, artificial
  Chemically synthesized
uguauacucccugccuug

SEQ ID NO: 10743 - RNA, 18 nt, artificial
  Chemically synthesized
cagucauuacuuaguagg

SEQ ID NO: 10744 - RNA, 18 nt, artificial
  Chemically synthesized
ugugauugagacuguaau

SEQ ID NO: 10745 - RNA, 18 nt, artificial
  Chemically synthesized
caccgggaauaaagucuc

SEQ ID NO: 10746 - RNA, 18 nt, artificial
  Chemically synthesized
uggagagugaguuaaaug

SEQ ID NO: 10747 - RNA, 18 nt, artificial
  Chemically synthesized
aagauaucuggaaggaag

SEQ ID NO: 10748 - RNA, 18 nt, artificial
  Chemically synthesized
aaaucacuuugagaacag

SEQ ID NO: 10749 - RNA, 18 nt, artificial
  Chemically synthesized
cacuggugucuucucuuc

SEQ ID NO: 10750 - RNA, 18 nt, artificial
  Chemically synthesized
cuuuaggcugguuguccc

SEQ ID NO: 10751 - RNA, 18 nt, artificial
  Chemically synthesized
acugaacaaguguuggac

SEQ ID NO: 10752 - RNA, 18 nt, artificial
  Chemically synthesized
ggaauaaagucucuguag

SEQ ID NO: 10753 - RNA, 18 nt, artificial
  Chemically synthesized
uggcugggaucagagucc

SEQ ID NO: 10754 - RNA, 18 nt, artificial
  Chemically synthesized
ugccuugaauaccuucac

SEQ ID NO: 10755 - RNA, 18 nt, artificial
  Chemically synthesized
ugucuucucuuccucgag

SEQ ID NO: 10756 - RNA, 18 nt, artificial
  Chemically synthesized
acugcuucugugagcagc

SEQ ID NO: 10757 - RNA, 18 nt, artificial
  Chemically synthesized
cagggauguucaaucacc

SEQ ID NO: 10758 - RNA, 18 nt, artificial
  Chemically synthesized
aagcaacucuggugugag

SEQ ID NO: 10759 - RNA, 18 nt, artificial
  Chemically synthesized
uacccacuguuccuucug

SEQ ID NO: 10760 - RNA, 18 nt, artificial
  Chemically synthesized
ugagaucuagaaacucaa

SEQ ID NO: 10761 - RNA, 18 nt, artificial
  Chemically synthesized
uauggauauuugaagcac

SEQ ID NO: 10762 - RNA, 18 nt, artificial
  Chemically synthesized
uucuguuucugaggaggc

SEQ ID NO: 10763 - RNA, 18 nt, artificial
  Chemically synthesized
ucgucuccagaagaugug

SEQ ID NO: 10764 - RNA, 18 nt, artificial
  Chemically synthesized
ccgacacaccaaugaugg

SEQ ID NO: 10765 - RNA, 18 nt, artificial
  Chemically synthesized
gaaacugccaggucugag

SEQ ID NO: 10766 - RNA, 18 nt, artificial
  Chemically synthesized
acccuuagcauaaggccu

SEQ ID NO: 10767 - RNA, 18 nt, artificial
  Chemically synthesized
ucaguaacaaacacuucu

SEQ ID NO: 10768 - RNA, 18 nt, artificial
  Chemically synthesized
cucacccuuagcauaagg

SEQ ID NO: 10769 - RNA, 18 nt, artificial
  Chemically synthesized
agagugaguuaaaugcug

SEQ ID NO: 10770 - RNA, 18 nt, artificial
  Chemically synthesized
aaaagaaguuguuguggc

SEQ ID NO: 10771 - RNA, 18 nt, artificial
  Chemically synthesized
gaacaaugucucuuucug

SEQ ID NO: 10772 - RNA, 18 nt, artificial
  Chemically synthesized
ggaaaagaacaaugucuc

SEQ ID NO: 10773 - RNA, 18 nt, artificial
  Chemically synthesized
uuaucucuuuugucacag

SEQ ID NO: 10774 - RNA, 18 nt, artificial
  Chemically synthesized
guuuccuuaggaauuagc

SEQ ID NO: 10775 - RNA, 18 nt, artificial
  Chemically synthesized
caaugauggucuuauuca

SEQ ID NO: 10776 - RNA, 18 nt, artificial
  Chemically synthesized
aguucauaggguucaggg

SEQ ID NO: 10777 - RNA, 18 nt, artificial
  Chemically synthesized
auauucaaacucagcaca

SEQ ID NO: 10778 - RNA, 18 nt, artificial
  Chemically synthesized
uguucacaaguacaagca

SEQ ID NO: 10779 - RNA, 18 nt, artificial
  Chemically synthesized
uugacacugagagagguc

SEQ ID NO: 10780 - RNA, 18 nt, artificial
  Chemically synthesized
gaaacuguccaaauuuac

SEQ ID NO: 10781 - RNA, 18 nt, artificial
  Chemically synthesized
acaaaggcaucauagaug

SEQ ID NO: 10782 - RNA, 18 nt, artificial
  Chemically synthesized
ggucuucuccaccuucug

SEQ ID NO: 10783 - RNA, 18 nt, artificial
  Chemically synthesized
uuguccuuuucuugaaug

SEQ ID NO: 10784 - RNA, 18 nt, artificial
  Chemically synthesized
uugccagccauuuucaag

SEQ ID NO: 10785 - RNA, 18 nt, artificial
  Chemically synthesized
ucugguguucacaaguac

SEQ ID NO: 10786 - RNA, 18 nt, artificial
  Chemically synthesized
aacucaugguaauaacac

SEQ ID NO: 10787 - RNA, 18 nt, artificial
  Chemically synthesized
gucaucccacuuccuucc

SEQ ID NO: 10788 - RNA, 18 nt, artificial
  Chemically synthesized
gauuuaagaaagcuagac

SEQ ID NO: 10789 - RNA, 18 nt, artificial
  Chemically synthesized
gauguucaaucacccuag

SEQ ID NO: 10790 - RNA, 18 nt, artificial
  Chemically synthesized
ugcucaaaccaaacacac

SEQ ID NO: 10791 - RNA, 18 nt, artificial
  Chemically synthesized
ucaugcggacacacacac

SEQ ID NO: 10792 - RNA, 18 nt, artificial
  Chemically synthesized
ccauugaaagcaacucug

SEQ ID NO: 10793 - RNA, 18 nt, artificial
  Chemically synthesized
uucaaagauacaccagcg

SEQ ID NO: 10794 - RNA, 18 nt, artificial
  Chemically synthesized
uguagugaaggcagagcu

SEQ ID NO: 10795 - RNA, 18 nt, artificial
  Chemically synthesized
ucuagugcaccauggaau

SEQ ID NO: 10796 - RNA, 18 nt, artificial
  Chemically synthesized
ucgcuaucaccgucugac

SEQ ID NO: 10797 - RNA, 18 nt, artificial
  Chemically synthesized
acugaggaccgacacacc

SEQ ID NO: 10798 - RNA, 18 nt, artificial
  Chemically synthesized
ccgggaauaaagucucug

SEQ ID NO: 10799 - RNA, 18 nt, artificial
  Chemically synthesized
uagauuggucagauuaga

SEQ ID NO: 10800 - RNA, 18 nt, artificial
  Chemically synthesized
aucugacaggugauauuc

SEQ ID NO: 10801 - RNA, 18 nt, artificial
  Chemically synthesized
aacaaucaccuuucggcu

SEQ ID NO: 10802 - RNA, 18 nt, artificial
  Chemically synthesized
auccucacugcuucugug

SEQ ID NO: 10803 - RNA, 18 nt, artificial
  Chemically synthesized
uucucuagagaugcuaga

SEQ ID NO: 10804 - RNA, 18 nt, artificial
  Chemically synthesized
agcugggcaagaaaugcc

SEQ ID NO: 10805 - RNA, 18 nt, artificial
  Chemically synthesized
uuggaagugaaaguaagc

SEQ ID NO: 10806 - RNA, 18 nt, artificial
  Chemically synthesized
ugcucagaaacugccagg

SEQ ID NO: 10807 - RNA, 18 nt, artificial
  Chemically synthesized
auggacuucuaaaccagc

SEQ ID NO: 10808 - RNA, 18 nt, artificial
  Chemically synthesized
uuuauucccucugcacug

SEQ ID NO: 10809 - RNA, 18 nt, artificial
  Chemically synthesized
agggucuucuccaccuuc

SEQ ID NO: 10810 - RNA, 18 nt, artificial
  Chemically synthesized
uuaggcucugauaugccc

SEQ ID NO: 10811 - RNA, 18 nt, artificial
  Chemically synthesized
uucucuuccucgagccgc

SEQ ID NO: 10812 - RNA, 18 nt, artificial
  Chemically synthesized
uacagauaugaucaugcg

SEQ ID NO: 10813 - RNA, 18 nt, artificial
  Chemically synthesized
auggguuccuugacugag

SEQ ID NO: 10814 - RNA, 18 nt, artificial
  Chemically synthesized
uguuggagacaacugcuc

SEQ ID NO: 10815 - RNA, 18 nt, artificial
  Chemically synthesized
ucauagauguuuucaccu

SEQ ID NO: 10816 - RNA, 18 nt, artificial
  Chemically synthesized
acaacucccuauuuccuc

SEQ ID NO: 10817 - RNA, 18 nt, artificial
  Chemically synthesized
aaguucauaggguucagg

SEQ ID NO: 10818 - RNA, 18 nt, artificial
  Chemically synthesized
ucuggaugaagugcuggg

SEQ ID NO: 10819 - RNA, 18 nt, artificial
  Chemically synthesized
cacucaguaacaaacacu

SEQ ID NO: 10820 - RNA, 18 nt, artificial
  Chemically synthesized
gugauauucaaacucagc

SEQ ID NO: 10821 - RNA, 18 nt, artificial
  Chemically synthesized
uacugaaaacucacucau

SEQ ID NO: 10822 - RNA, 18 nt, artificial
  Chemically synthesized
accagaacugcuacaaca

SEQ ID NO: 10823 - RNA, 18 nt, artificial
  Chemically synthesized
auggcugggaucagaguc

SEQ ID NO: 10824 - RNA, 18 nt, artificial
  Chemically synthesized
acacuguccucccacucc

SEQ ID NO: 10825 - RNA, 18 nt, artificial
  Chemically synthesized
aaucuuguugcuggaaag

SEQ ID NO: 10826 - RNA, 18 nt, artificial
  Chemically synthesized
cagacacauuguuuucuc

SEQ ID NO: 10827 - RNA, 18 nt, artificial
  Chemically synthesized
aguucucuagagaugcua

SEQ ID NO: 10828 - RNA, 18 nt, artificial
  Chemically synthesized
uugaauguucuguuucug

SEQ ID NO: 10829 - RNA, 18 nt, artificial
  Chemically synthesized
guuuugagauguccaaug

SEQ ID NO: 10830 - RNA, 18 nt, artificial
  Chemically synthesized
guggcuaaagaaacagca

SEQ ID NO: 10831 - RNA, 18 nt, artificial
  Chemically synthesized
uccaagugcucuagauug

SEQ ID NO: 10832 - RNA, 18 nt, artificial
  Chemically synthesized
uguuucugaggaggcugg

SEQ ID NO: 10833 - RNA, 18 nt, artificial
  Chemically synthesized
aucugugucucccuaaag

SEQ ID NO: 10834 - RNA, 18 nt, artificial
  Chemically synthesized
ucuuuugucacaggagag

SEQ ID NO: 10835 - RNA, 18 nt, artificial
  Chemically synthesized
gaauaaagucucuguagu

SEQ ID NO: 10836 - RNA, 18 nt, artificial
  Chemically synthesized
gauggacuucuaaaccag

SEQ ID NO: 10837 - RNA, 18 nt, artificial
  Chemically synthesized
uucguucaacuuccacca

SEQ ID NO: 10838 - RNA, 18 nt, artificial
  Chemically synthesized
ucuaaauacuuuaggcug

SEQ ID NO: 10839 - RNA, 18 nt, artificial
  Chemically synthesized
ucuagagaugcuagauuu

SEQ ID NO: 10840 - RNA, 18 nt, artificial
  Chemically synthesized
ucauuccuuacccagucc

SEQ ID NO: 10841 - RNA, 18 nt, artificial
  Chemically synthesized
aagacuggagagugaguu

SEQ ID NO: 10842 - RNA, 18 nt, artificial
  Chemically synthesized
cauugaaagcaacucugg

SEQ ID NO: 10843 - RNA, 18 nt, artificial
  Chemically synthesized
aggucaaguuucucagcu

SEQ ID NO: 10844 - RNA, 18 nt, artificial
  Chemically synthesized
uaacauccacucuuccca

SEQ ID NO: 10845 - RNA, 18 nt, artificial
  Chemically synthesized
gaaacagcaauguauacu

SEQ ID NO: 10846 - RNA, 18 nt, artificial
  Chemically synthesized
auguuuucaccucuacca

SEQ ID NO: 10847 - RNA, 18 nt, artificial
  Chemically synthesized
aaccuucauggaugaugu

SEQ ID NO: 10848 - RNA, 18 nt, artificial
  Chemically synthesized
augacagucauuacuuag

SEQ ID NO: 10849 - RNA, 18 nt, artificial
  Chemically synthesized
gcuccuugagauuagcag

SEQ ID NO: 10850 - RNA, 18 nt, artificial
  Chemically synthesized
accuuucggcuuuuaugg

SEQ ID NO: 10851 - RNA, 18 nt, artificial
  Chemically synthesized
agauucagagguccauca

SEQ ID NO: 10852 - RNA, 18 nt, artificial
  Chemically synthesized
uaaagagauucagagguc

SEQ ID NO: 10853 - RNA, 18 nt, artificial
  Chemically synthesized
aagaugccauugaaagca

SEQ ID NO: 10854 - RNA, 18 nt, artificial
  Chemically synthesized
gaaaugucaagguaaaug

SEQ ID NO: 10855 - RNA, 18 nt, artificial
  Chemically synthesized
ucaaggcuugguagauca

SEQ ID NO: 10856 - RNA, 18 nt, artificial
  Chemically synthesized
caaacacuucugacugug

SEQ ID NO: 10857 - RNA, 18 nt, artificial
  Chemically synthesized
ucuagauuggucagauua

SEQ ID NO: 10858 - RNA, 18 nt, artificial
  Chemically synthesized
uguaguuccuguuuuuug

SEQ ID NO: 10859 - RNA, 18 nt, artificial
  Chemically synthesized
uuugaguuucaauguggg

SEQ ID NO: 10860 - RNA, 18 nt, artificial
  Chemically synthesized
ccauuucuacugagaucu

SEQ ID NO: 10861 - RNA, 18 nt, artificial
  Chemically synthesized
ucuagcccaaauugucca

SEQ ID NO: 10862 - RNA, 18 nt, artificial
  Chemically synthesized
aaaauguggucaaggagc

SEQ ID NO: 10863 - RNA, 18 nt, artificial
  Chemically synthesized
agcccugcauaucuagug

SEQ ID NO: 10864 - RNA, 18 nt, artificial
  Chemically synthesized
uuucaugacagucauuac

SEQ ID NO: 10865 - RNA, 18 nt, artificial
  Chemically synthesized
accaguggcuaaagaaac

SEQ ID NO: 10866 - RNA, 18 nt, artificial
  Chemically synthesized
uguacccacuguuccuuc

SEQ ID NO: 10867 - RNA, 18 nt, artificial
  Chemically synthesized
auagaacuuauagaccag

SEQ ID NO: 10868 - RNA, 18 nt, artificial
  Chemically synthesized
acugcuacaacagauacu

SEQ ID NO: 10869 - RNA, 18 nt, artificial
  Chemically synthesized
guaguagucuaaguaugc

SEQ ID NO: 10870 - RNA, 18 nt, artificial
  Chemically synthesized
aguucagucaaaacuacc

SEQ ID NO: 10871 - RNA, 18 nt, artificial
  Chemically synthesized
cauggaauuacucacccu

SEQ ID NO: 10872 - RNA, 18 nt, artificial
  Chemically synthesized
auugugagccacauuaag

SEQ ID NO: 10873 - RNA, 18 nt, artificial
  Chemically synthesized
acaugcucgagaaugacc

SEQ ID NO: 10874 - RNA, 18 nt, artificial
  Chemically synthesized
cugauagggauacauagg

SEQ ID NO: 10875 - RNA, 18 nt, artificial
  Chemically synthesized
cuuugagaacagcaaccu

SEQ ID NO: 10876 - RNA, 18 nt, artificial
  Chemically synthesized
augauaccagcacgacug

SEQ ID NO: 10877 - RNA, 18 nt, artificial
  Chemically synthesized
acacacucugaaacacuc

SEQ ID NO: 10878 - RNA, 18 nt, artificial
  Chemically synthesized
caucuucaauugucugga

SEQ ID NO: 10879 - RNA, 18 nt, artificial
  Chemically synthesized
cucauuccuuacccaguc

SEQ ID NO: 10880 - RNA, 18 nt, artificial
  Chemically synthesized
uaccauacuuuaugcagc

SEQ ID NO: 10881 - RNA, 18 nt, artificial
  Chemically synthesized
acacuuauaaggaaacgu

SEQ ID NO: 10882 - RNA, 18 nt, artificial
  Chemically synthesized
uggucaaggagcauugcc

SEQ ID NO: 10883 - RNA, 18 nt, artificial
  Chemically synthesized
aaccuuagcauucuggac

SEQ ID NO: 10884 - RNA, 18 nt, artificial
  Chemically synthesized
aaagucauucugaguaag

SEQ ID NO: 10885 - RNA, 18 nt, artificial
  Chemically synthesized
gcaaccuuagcauucugg

SEQ ID NO: 10886 - RNA, 18 nt, artificial
  Chemically synthesized
aggaaaagaacaaugucu

SEQ ID NO: 10887 - RNA, 18 nt, artificial
  Chemically synthesized
uaggguucagggacaggu

SEQ ID NO: 10888 - RNA, 18 nt, artificial
  Chemically synthesized
ucaaacaucacuuguucu

SEQ ID NO: 10889 - RNA, 18 nt, artificial
  Chemically synthesized
ucccugccuugaauaccu

SEQ ID NO: 10890 - RNA, 18 nt, artificial
  Chemically synthesized
agacuggacaagccauug

SEQ ID NO: 10891 - RNA, 18 nt, artificial
  Chemically synthesized
uuuccucauuucucccuu

SEQ ID NO: 10892 - RNA, 18 nt, artificial
  Chemically synthesized
cauuugauguagaacccg

SEQ ID NO: 10893 - RNA, 18 nt, artificial
  Chemically synthesized
auaacaccauugaagcuc

SEQ ID NO: 10894 - RNA, 18 nt, artificial
  Chemically synthesized
auugaaagcaacucuggu

SEQ ID NO: 10895 - RNA, 18 nt, artificial
  Chemically synthesized
cugcauaucuagugcacc

SEQ ID NO: 10896 - RNA, 18 nt, artificial
  Chemically synthesized
augguuuuaugauggcua

SEQ ID NO: 10897 - RNA, 18 nt, artificial
  Chemically synthesized
ccuauuuccucauuucuc

SEQ ID NO: 10898 - RNA, 18 nt, artificial
  Chemically synthesized
uucuuuacuagcucauuc

SEQ ID NO: 10899 - RNA, 18 nt, artificial
  Chemically synthesized
acacucugaaacacucag

SEQ ID NO: 10900 - RNA, 18 nt, artificial
  Chemically synthesized
gauguuuucaccucuacc

SEQ ID NO: 10901 - RNA, 18 nt, artificial
  Chemically synthesized
gacacaccaaugaugguc

SEQ ID NO: 10902 - RNA, 18 nt, artificial
  Chemically synthesized
agaaaacgccugcagacc

SEQ ID NO: 10903 - RNA, 18 nt, artificial
  Chemically synthesized
cugagaucuagaaacuca

SEQ ID NO: 10904 - RNA, 18 nt, artificial
  Chemically synthesized
aaguucucuagagaugcu

SEQ ID NO: 10905 - RNA, 18 nt, artificial
  Chemically synthesized
cacugaggaccgacacac

SEQ ID NO: 10906 - RNA, 18 nt, artificial
  Chemically synthesized
aagcuccuugagauuagc

SEQ ID NO: 10907 - RNA, 18 nt, artificial
  Chemically synthesized
agaggaaguuagaagaag

SEQ ID NO: 10908 - RNA, 18 nt, artificial
  Chemically synthesized
caauugguguauucaaag

SEQ ID NO: 10909 - RNA, 18 nt, artificial
  Chemically synthesized
auccuguacccacuguuc

SEQ ID NO: 10910 - RNA, 18 nt, artificial
  Chemically synthesized
uaaaccagccagaccuug

SEQ ID NO: 10911 - RNA, 18 nt, artificial
  Chemically synthesized
aaugucaagguaaaugag

SEQ ID NO: 10912 - RNA, 18 nt, artificial
  Chemically synthesized
agcacaagaguagagaac

SEQ ID NO: 10913 - RNA, 18 nt, artificial
  Chemically synthesized
augguaauaacaccauug

SEQ ID NO: 10914 - RNA, 18 nt, artificial
  Chemically synthesized
augagacauggaaacaca

SEQ ID NO: 10915 - RNA, 18 nt, artificial
  Chemically synthesized
agaacagcaaccuuugaa

SEQ ID NO: 10916 - RNA, 18 nt, artificial
  Chemically synthesized
uuguccaugauaagacca

SEQ ID NO: 10917 - RNA, 18 nt, artificial
  Chemically synthesized
agucgucuccagaagaug

SEQ ID NO: 10918 - RNA, 18 nt, artificial
  Chemically synthesized
ccuagaccugcucaaacc

SEQ ID NO: 10919 - RNA, 18 nt, artificial
  Chemically synthesized
uuuccaguuuugacaacu

SEQ ID NO: 10920 - RNA, 18 nt, artificial
  Chemically synthesized
gcaguucugggcuaaagg

SEQ ID NO: 10921 - RNA, 18 nt, artificial
  Chemically synthesized
ggaauacugaaaacucac

SEQ ID NO: 10922 - RNA, 18 nt, artificial
  Chemically synthesized
auagggauacauagggau

SEQ ID NO: 10923 - RNA, 18 nt, artificial
  Chemically synthesized
guugaaaugcccaccugg

SEQ ID NO: 10924 - RNA, 18 nt, artificial
  Chemically synthesized
aaucacuuugagaacagc

SEQ ID NO: 10925 - RNA, 18 nt, artificial
  Chemically synthesized
ugcuguuggagacaacug

SEQ ID NO: 10926 - RNA, 18 nt, artificial
  Chemically synthesized
gaaagcuagacuacuugg

SEQ ID NO: 10927 - RNA, 18 nt, artificial
  Chemically synthesized
gaagcggaaauuuucuuc

SEQ ID NO: 10928 - RNA, 18 nt, artificial
  Chemically synthesized
aagaaaugccucaggagg

SEQ ID NO: 10929 - RNA, 18 nt, artificial
  Chemically synthesized
uccuugauccauugcagg

SEQ ID NO: 10930 - RNA, 18 nt, artificial
  Chemically synthesized
aaguuugaacucauggua

SEQ ID NO: 10931 - RNA, 18 nt, artificial
  Chemically synthesized
ucuaaguaugcuaaucgg

SEQ ID NO: 10932 - RNA, 18 nt, artificial
  Chemically synthesized
guugguugaaaugcccac

SEQ ID NO: 10933 - RNA, 18 nt, artificial
  Chemically synthesized
aacucacucauuuguuuc

SEQ ID NO: 10934 - RNA, 18 nt, artificial
  Chemically synthesized
aagagcugccucuggucc

SEQ ID NO: 10935 - RNA, 18 nt, artificial
  Chemically synthesized
uacauagggauaugugca

SEQ ID NO: 10936 - RNA, 18 nt, artificial
  Chemically synthesized
aguucagacacuuauaag

SEQ ID NO: 10937 - RNA, 18 nt, artificial
  Chemically synthesized
cuuucacuaguacaugag

SEQ ID NO: 10938 - RNA, 18 nt, artificial
  Chemically synthesized
aaagcggcaaccuuagca

SEQ ID NO: 10939 - RNA, 18 nt, artificial
  Chemically synthesized
uaguccagaaaaggcucc

SEQ ID NO: 10940 - RNA, 18 nt, artificial
  Chemically synthesized
gauagauguugcuuccug

SEQ ID NO: 10941 - RNA, 18 nt, artificial
  Chemically synthesized
agauugugagccacauua

SEQ ID NO: 10942 - RNA, 18 nt, artificial
  Chemically synthesized
ugagaaggcgguacagcu

SEQ ID NO: 10943 - RNA, 18 nt, artificial
  Chemically synthesized
cugaguugguugaaaugc

SEQ ID NO: 10944 - RNA, 18 nt, artificial
  Chemically synthesized
cuaguacaugagacaugg

SEQ ID NO: 10945 - RNA, 18 nt, artificial
  Chemically synthesized
cucacugcuucugugagc

SEQ ID NO: 10946 - RNA, 18 nt, artificial
  Chemically synthesized
uagacuacuuggaaaaug

SEQ ID NO: 10947 - RNA, 18 nt, artificial
  Chemically synthesized
gggucuucuccaccuucu

SEQ ID NO: 10948 - RNA, 18 nt, artificial
  Chemically synthesized
aaacaucacuuguucuga

SEQ ID NO: 10949 - RNA, 18 nt, artificial
  Chemically synthesized
aacacacucugaaacacu

SEQ ID NO: 10950 - RNA, 18 nt, artificial
  Chemically synthesized
acuucugcugcaacucau

SEQ ID NO: 10951 - RNA, 18 nt, artificial
  Chemically synthesized
uuggauaagauugugagc

SEQ ID NO: 10952 - RNA, 18 nt, artificial
  Chemically synthesized
caguucugggcuaaaggg

SEQ ID NO: 10953 - RNA, 18 nt, artificial
  Chemically synthesized
ggaauucuucaaugguca

SEQ ID NO: 10954 - RNA, 18 nt, artificial
  Chemically synthesized
ugacaaagugacagagug

SEQ ID NO: 10955 - RNA, 18 nt, artificial
  Chemically synthesized
acucaucucaaacagcca

SEQ ID NO: 10956 - RNA, 18 nt, artificial
  Chemically synthesized
aagcacgucuuaaacaac

SEQ ID NO: 10957 - RNA, 18 nt, artificial
  Chemically synthesized
uggucucacgcaggagag

SEQ ID NO: 10958 - RNA, 18 nt, artificial
  Chemically synthesized
acaccgggaauaaagucu

SEQ ID NO: 10959 - RNA, 18 nt, artificial
  Chemically synthesized
agauuggauaagauugug

SEQ ID NO: 10960 - RNA, 18 nt, artificial
  Chemically synthesized
uaucuggaaggaaguuuu

SEQ ID NO: 10961 - RNA, 18 nt, artificial
  Chemically synthesized
cugauuguccuuuucuug

SEQ ID NO: 10962 - RNA, 18 nt, artificial
  Chemically synthesized
gaaacucaaggcuuggua

SEQ ID NO: 10963 - RNA, 18 nt, artificial
  Chemically synthesized
acuugaugagguaagagu

SEQ ID NO: 10964 - RNA, 18 nt, artificial
  Chemically synthesized
aaacacacucugaaacac

SEQ ID NO: 10965 - RNA, 18 nt, artificial
  Chemically synthesized
augaacauucuuuucugg

SEQ ID NO: 10966 - RNA, 18 nt, artificial
  Chemically synthesized
aaucaagaaaaggugacc

SEQ ID NO: 10967 - RNA, 18 nt, artificial
  Chemically synthesized
caugauuuaccauccagc

SEQ ID NO: 10968 - RNA, 18 nt, artificial
  Chemically synthesized
acuguaaucaagaaccug

SEQ ID NO: 10969 - RNA, 18 nt, artificial
  Chemically synthesized
aacagcaaccuuugaaac

SEQ ID NO: 10970 - RNA, 18 nt, artificial
  Chemically synthesized
caguugacacugagagag

SEQ ID NO: 10971 - RNA, 18 nt, artificial
  Chemically synthesized
auaccuucacacguaguu

SEQ ID NO: 10972 - RNA, 18 nt, artificial
  Chemically synthesized
auagauguuuucaccucu

SEQ ID NO: 10973 - RNA, 18 nt, artificial
  Chemically synthesized
uagagaugcuagauuugu

SEQ ID NO: 10974 - RNA, 18 nt, artificial
  Chemically synthesized
auauuugaagcacgucuu

SEQ ID NO: 10975 - RNA, 18 nt, artificial
  Chemically synthesized
gucucuguagugaaggca

SEQ ID NO: 10976 - RNA, 18 nt, artificial
  Chemically synthesized
ucaaugauaacauccacu

SEQ ID NO: 10977 - RNA, 18 nt, artificial
  Chemically synthesized
cugguuggauaaaguuca

SEQ ID NO: 10978 - RNA, 18 nt, artificial
  Chemically synthesized
ugucucuuucuguuuucu

SEQ ID NO: 10979 - RNA, 18 nt, artificial
  Chemically synthesized
aaggucaaguuucucagc

SEQ ID NO: 10980 - RNA, 18 nt, artificial
  Chemically synthesized
ucacugcuucugugagca

SEQ ID NO: 10981 - RNA, 18 nt, artificial
  Chemically synthesized
uagagaacucaucucaaa

SEQ ID NO: 10982 - RNA, 18 nt, artificial
  Chemically synthesized
ggcucuggaugaagugcu

SEQ ID NO: 10983 - RNA, 18 nt, artificial
  Chemically synthesized
uugcauccuguacccacu

SEQ ID NO: 10984 - RNA, 18 nt, artificial
  Chemically synthesized
ccaucuucaauugucugg

SEQ ID NO: 10985 - RNA, 18 nt, artificial
  Chemically synthesized
agagucccagccaggcgc

SEQ ID NO: 10986 - RNA, 18 nt, artificial
  Chemically synthesized
uuucuaaauucucccaga

SEQ ID NO: 10987 - RNA, 18 nt, artificial
  Chemically synthesized
uagcucauuccuuaccca

SEQ ID NO: 10988 - RNA, 18 nt, artificial
  Chemically synthesized
cuuuuccaaguuuccuuc

SEQ ID NO: 10989 - RNA, 18 nt, artificial
  Chemically synthesized
aggcacuggugucuucuc

SEQ ID NO: 10990 - RNA, 18 nt, artificial
  Chemically synthesized
uugccauccgaaauuaua

SEQ ID NO: 10991 - RNA, 18 nt, artificial
  Chemically synthesized
aaugcuggaaauccagau

SEQ ID NO: 10992 - RNA, 18 nt, artificial
  Chemically synthesized
aguucugggcuaaagggu

SEQ ID NO: 10993 - RNA, 18 nt, artificial
  Chemically synthesized
aacaaugucucuuucugu

SEQ ID NO: 10994 - RNA, 18 nt, artificial
  Chemically synthesized
cuucuaaaccagccagac

SEQ ID NO: 10995 - RNA, 18 nt, artificial
  Chemically synthesized
aucacccuagaccugcuc

SEQ ID NO: 10996 - RNA, 18 nt, artificial
  Chemically synthesized
uucccucugcacuggaag

SEQ ID NO: 10997 - RNA, 18 nt, artificial
  Chemically synthesized
gggagacuacuguacaag

SEQ ID NO: 10998 - RNA, 18 nt, artificial
  Chemically synthesized
gaucuaaauacuuuaggc

SEQ ID NO: 10999 - RNA, 18 nt, artificial
  Chemically synthesized
cuuuguuggaagugaaag

SEQ ID NO: 11000 - RNA, 18 nt, artificial
  Chemically synthesized
uuuaaaugcaccugguug

SEQ ID NO: 11001 - RNA, 18 nt, artificial
  Chemically synthesized
acaaguguuggacccagc

SEQ ID NO: 11002 - RNA, 18 nt, artificial
  Chemically synthesized
cucaaggcuugguagauc

SEQ ID NO: 11003 - RNA, 18 nt, artificial
  Chemically synthesized
acaacaaucaccuuucgg

SEQ ID NO: 11004 - RNA, 18 nt, artificial
  Chemically synthesized
caugcucgagaaugacca

SEQ ID NO: 11005 - RNA, 18 nt, artificial
  Chemically synthesized
uaaggaaacguauccaau

SEQ ID NO: 11006 - RNA, 18 nt, artificial
  Chemically synthesized
cuuauaaggaaacguauc

SEQ ID NO: 11007 - RNA, 18 nt, artificial
  Chemically synthesized
auaaagucucuguaguga

SEQ ID NO: 11008 - RNA, 18 nt, artificial
  Chemically synthesized
cauuuucaagacuucgag

SEQ ID NO: 11009 - RNA, 18 nt, artificial
  Chemically synthesized
ugaggaggcuggaugaac

SEQ ID NO: 11010 - RNA, 18 nt, artificial
  Chemically synthesized
cgacugcucagaaacugc

SEQ ID NO: 11011 - RNA, 18 nt, artificial
  Chemically synthesized
uggaaagguccaagugcu

SEQ ID NO: 11012 - RNA, 18 nt, artificial
  Chemically synthesized
augcuggaaauccagaug

SEQ ID NO: 11013 - RNA, 18 nt, artificial
  Chemically synthesized
ugaagaugauaccagcac

SEQ ID NO: 11014 - RNA, 18 nt, artificial
  Chemically synthesized
guaauaacaccauugaag

SEQ ID NO: 11015 - RNA, 18 nt, artificial
  Chemically synthesized
agcggaaauuuucuuccc

SEQ ID NO: 11016 - RNA, 18 nt, artificial
  Chemically synthesized
aaucacccuagaccugcu

SEQ ID NO: 11017 - RNA, 18 nt, artificial
  Chemically synthesized
uuucucagcucugugaag

SEQ ID NO: 11018 - RNA, 18 nt, artificial
  Chemically synthesized
agacuuaaaauggaaggg

SEQ ID NO: 11019 - RNA, 18 nt, artificial
  Chemically synthesized
ucuggaaggaaguuuucc

SEQ ID NO: 11020 - RNA, 18 nt, artificial
  Chemically synthesized
uacuuucacuaguacaug

SEQ ID NO: 11021 - RNA, 18 nt, artificial
  Chemically synthesized
cuugaauaccuucacacg

SEQ ID NO: 11022 - RNA, 18 nt, artificial
  Chemically synthesized
ugagaggaagugaaagcg

SEQ ID NO: 11023 - RNA, 18 nt, artificial
  Chemically synthesized
ucaaaccaaacacacucu

SEQ ID NO: 11024 - RNA, 18 nt, artificial
  Chemically synthesized
aggugauauucaaacuca

SEQ ID NO: 11025 - RNA, 18 nt, artificial
  Chemically synthesized
cucauuucucccuuccuc

SEQ ID NO: 11026 - RNA, 18 nt, artificial
  Chemically synthesized
cucaggaaaagaacaaug

SEQ ID NO: 11027 - RNA, 18 nt, artificial
  Chemically synthesized
aaugguuuuaugauggcu

SEQ ID NO: 11028 - RNA, 18 nt, artificial
  Chemically synthesized
uggaaucaagaaaaggug

SEQ ID NO: 11029 - RNA, 18 nt, artificial
  Chemically synthesized
acaaaugcacacaucuac

SEQ ID NO: 11030 - RNA, 18 nt, artificial
  Chemically synthesized
gugaaaguaagccuuuug

SEQ ID NO: 11031 - RNA, 18 nt, artificial
  Chemically synthesized
uguggucaaggagcauug

SEQ ID NO: 11032 - RNA, 18 nt, artificial
  Chemically synthesized
uaguagucuaaguaugcu

SEQ ID NO: 11033 - RNA, 18 nt, artificial
  Chemically synthesized
cucagcacaggcaugccc

SEQ ID NO: 11034 - RNA, 18 nt, artificial
  Chemically synthesized
ucgagaaugaccaggaug

SEQ ID NO: 11035 - RNA, 18 nt, artificial
  Chemically synthesized
aagaacaaugucucuuuc

SEQ ID NO: 11036 - RNA, 18 nt, artificial
  Chemically synthesized
gcauucccaccuuuguug

SEQ ID NO: 11037 - RNA, 18 nt, artificial
  Chemically synthesized
gcaaucucauauucaaag

SEQ ID NO: 11038 - RNA, 18 nt, artificial
  Chemically synthesized
ugcaggacaaugaagaug

SEQ ID NO: 11039 - RNA, 18 nt, artificial
  Chemically synthesized
aaagugaacacccaguuc

SEQ ID NO: 11040 - RNA, 18 nt, artificial
  Chemically synthesized
uuccuuacccaguccuca

SEQ ID NO: 11041 - RNA, 18 nt, artificial
  Chemically synthesized
gaauuagccacuagacuu

SEQ ID NO: 11042 - RNA, 18 nt, artificial
  Chemically synthesized
aucuugcaucaggagccc

SEQ ID NO: 11043 - RNA, 18 nt, artificial
  Chemically synthesized
acgccugcagaccagugg

SEQ ID NO: 11044 - RNA, 18 nt, artificial
  Chemically synthesized
uguacuuuuccauacuuc

SEQ ID NO: 11045 - RNA, 18 nt, artificial
  Chemically synthesized
agacacuuauaaggaaac

SEQ ID NO: 11046 - RNA, 18 nt, artificial
  Chemically synthesized
gaugaacauucuuuucug

SEQ ID NO: 11047 - RNA, 18 nt, artificial
  Chemically synthesized
auguguuaaucagguuuc

SEQ ID NO: 11048 - RNA, 18 nt, artificial
  Chemically synthesized
augcacacaucuacuuuc

SEQ ID NO: 11049 - RNA, 18 nt, artificial
  Chemically synthesized
agacucaggaaaagaaca

SEQ ID NO: 11050 - RNA, 18 nt, artificial
  Chemically synthesized
aagaaguuugaacucaug

SEQ ID NO: 11051 - RNA, 18 nt, artificial
  Chemically synthesized
aagagagauugaguaggg

SEQ ID NO: 11052 - RNA, 18 nt, artificial
  Chemically synthesized
agaccaggaagcggaaau

SEQ ID NO: 11053 - RNA, 18 nt, artificial
  Chemically synthesized
uuucaauagucacacuca

SEQ ID NO: 11054 - RNA, 18 nt, artificial
  Chemically synthesized
aucccagccaucuguguc

SEQ ID NO: 11055 - RNA, 18 nt, artificial
  Chemically synthesized
agacacauuguuuucuca

SEQ ID NO: 11056 - RNA, 18 nt, artificial
  Chemically synthesized
ggcacuggugucuucucu

SEQ ID NO: 11057 - RNA, 18 nt, artificial
  Chemically synthesized
cuuacccaguccucaucc

SEQ ID NO: 11058 - RNA, 18 nt, artificial
  Chemically synthesized
uucugacuguggucauau

SEQ ID NO: 11059 - RNA, 18 nt, artificial
  Chemically synthesized
gguaguagucuaaguaug

SEQ ID NO: 11060 - RNA, 18 nt, artificial
  Chemically synthesized
uugauaguccagaaaagg

SEQ ID NO: 11061 - RNA, 18 nt, artificial
  Chemically synthesized
auaucaucgagguaguag

SEQ ID NO: 11062 - RNA, 18 nt, artificial
  Chemically synthesized
uuucugaggcacuggugu

SEQ ID NO: 11063 - RNA, 18 nt, artificial
  Chemically synthesized
acaggucuaaagagagau

SEQ ID NO: 11064 - RNA, 18 nt, artificial
  Chemically synthesized
aagaaguuguuguggcuc

SEQ ID NO: 11065 - RNA, 18 nt, artificial
  Chemically synthesized
cagauacuacaagcacac

SEQ ID NO: 11066 - RNA, 18 nt, artificial
  Chemically synthesized
ucuaaagagagauugagu

SEQ ID NO: 11067 - RNA, 18 nt, artificial
  Chemically synthesized
acucucuucuauacagau

SEQ ID NO: 11068 - RNA, 18 nt, artificial
  Chemically synthesized
uuuggaaugacaucgagu

SEQ ID NO: 11069 - RNA, 18 nt, artificial
  Chemically synthesized
gcacuggugucuucucuu

SEQ ID NO: 11070 - RNA, 18 nt, artificial
  Chemically synthesized
auggucaaauugcacagg

SEQ ID NO: 11071 - RNA, 18 nt, artificial
  Chemically synthesized
uguuaaucagguuuccuu

SEQ ID NO: 11072 - RNA, 18 nt, artificial
  Chemically synthesized
cuuaucugaagguguugc

SEQ ID NO: 11073 - RNA, 18 nt, artificial
  Chemically synthesized
accauugaagcucagauc

SEQ ID NO: 11074 - RNA, 18 nt, artificial
  Chemically synthesized
uaccugaagacuggagag

SEQ ID NO: 11075 - RNA, 18 nt, artificial
  Chemically synthesized
gguccaucaaacaucacu

SEQ ID NO: 11076 - RNA, 18 nt, artificial
  Chemically synthesized
uacaacagauacuacaag

SEQ ID NO: 11077 - RNA, 18 nt, artificial
  Chemically synthesized
guccuugauccauugcag

SEQ ID NO: 11078 - RNA, 18 nt, artificial
  Chemically synthesized
ccaaugauggucuuauuc

SEQ ID NO: 11079 - RNA, 18 nt, artificial
  Chemically synthesized
gccacauuaaguucuuuc

SEQ ID NO: 11080 - RNA, 18 nt, artificial
  Chemically synthesized
uuucugagugauaggaau

SEQ ID NO: 11081 - RNA, 18 nt, artificial
  Chemically synthesized
cgucuuaaacaaccuuau

SEQ ID NO: 11082 - RNA, 18 nt, artificial
  Chemically synthesized
cucccagcuuucuggucu

SEQ ID NO: 11083 - RNA, 18 nt, artificial
  Chemically synthesized
aaggcagagcugaaaugg

SEQ ID NO: 11084 - RNA, 18 nt, artificial
  Chemically synthesized
uccaucaaacaucacuug

SEQ ID NO: 11085 - RNA, 18 nt, artificial
  Chemically synthesized
uuuugucacaggagagga

SEQ ID NO: 11086 - RNA, 18 nt, artificial
  Chemically synthesized
ugaagacuggagagugag

SEQ ID NO: 11087 - RNA, 18 nt, artificial
  Chemically synthesized
ugaagguguugcacauuc

SEQ ID NO: 11088 - RNA, 18 nt, artificial
  Chemically synthesized
uggcuugaguagauaaca

SEQ ID NO: 11089 - RNA, 18 nt, artificial
  Chemically synthesized
cuacaagcacacugagga

SEQ ID NO: 11090 - RNA, 18 nt, artificial
  Chemically synthesized
agauaugaucaugcggac

SEQ ID NO: 11091 - RNA, 18 nt, artificial
  Chemically synthesized
uagcccaaauuguccaug

SEQ ID NO: 11092 - RNA, 18 nt, artificial
  Chemically synthesized
gauuugucuccacagcca

SEQ ID NO: 11093 - RNA, 18 nt, artificial
  Chemically synthesized
ugagcauguguuaaucag

SEQ ID NO: 11094 - RNA, 18 nt, artificial
  Chemically synthesized
ucuucaauugucuggauu

SEQ ID NO: 11095 - RNA, 18 nt, artificial
  Chemically synthesized
caauugcauccuguaccc

SEQ ID NO: 11096 - RNA, 18 nt, artificial
  Chemically synthesized
acagcaaccuuugaaacu

SEQ ID NO: 11097 - RNA, 18 nt, artificial
  Chemically synthesized
gggcucccagcuuucugg

SEQ ID NO: 11098 - RNA, 18 nt, artificial
  Chemically synthesized
uaaggccugacauguggc

SEQ ID NO: 11099 - RNA, 18 nt, artificial
  Chemically synthesized
guaagaguugaaaugacu

SEQ ID NO: 11100 - RNA, 18 nt, artificial
  Chemically synthesized
guaacaaacacuucugac

SEQ ID NO: 11101 - RNA, 18 nt, artificial
  Chemically synthesized
gugagaggaagugaaagc

SEQ ID NO: 11102 - RNA, 18 nt, artificial
  Chemically synthesized
ugucaagguaaaugaggu

SEQ ID NO: 11103 - RNA, 18 nt, artificial
  Chemically synthesized
gggcuaaacucuggaugg

SEQ ID NO: 11104 - RNA, 18 nt, artificial
  Chemically synthesized
uucugugagcagcagugg

SEQ ID NO: 11105 - RNA, 18 nt, artificial
  Chemically synthesized
gcucccagggcuaaacuc

SEQ ID NO: 11106 - RNA, 18 nt, artificial
  Chemically synthesized
uuaagguagagagguggc

SEQ ID NO: 11107 - RNA, 18 nt, artificial
  Chemically synthesized
aagcggcaaccuuagcau

SEQ ID NO: 11108 - RNA, 18 nt, artificial
  Chemically synthesized
acuaguacaugagacaug

SEQ ID NO: 11109 - RNA, 18 nt, artificial
  Chemically synthesized
gaaguuugaacucauggu

SEQ ID NO: 11110 - RNA, 18 nt, artificial
  Chemically synthesized
aaaggaaaaagugaacac

SEQ ID NO: 11111 - RNA, 18 nt, artificial
  Chemically synthesized
uuacucacccuuagcaua

SEQ ID NO: 11112 - RNA, 18 nt, artificial
  Chemically synthesized
uaaagagagauugaguag

SEQ ID NO: 11113 - RNA, 18 nt, artificial
  Chemically synthesized
aaagaaguuguuguggcu

SEQ ID NO: 11114 - RNA, 18 nt, artificial
  Chemically synthesized
ugcaccauggaauuacuc

SEQ ID NO: 11115 - RNA, 18 nt, artificial
  Chemically synthesized
guccaucaaacaucacuu

SEQ ID NO: 11116 - RNA, 18 nt, artificial
  Chemically synthesized
ucaaguuucucagcucug

SEQ ID NO: 11117 - RNA, 18 nt, artificial
  Chemically synthesized
aggcucccagggcuaaac

SEQ ID NO: 11118 - RNA, 18 nt, artificial
  Chemically synthesized
agccaucugugucucccu

SEQ ID NO: 11119 - RNA, 18 nt, artificial
  Chemically synthesized
agauuagcagcccugcau

SEQ ID NO: 11120 - RNA, 18 nt, artificial
  Chemically synthesized
cauucuggacuuuuguuu

SEQ ID NO: 11121 - RNA, 18 nt, artificial
  Chemically synthesized
cuuuugagagauuugagu

SEQ ID NO: 11122 - RNA, 18 nt, artificial
  Chemically synthesized
acaaugucucuuucuguu

SEQ ID NO: 11123 - RNA, 18 nt, artificial
  Chemically synthesized
ucuacuuucacuaguaca

SEQ ID NO: 11124 - RNA, 18 nt, artificial
  Chemically synthesized
ggaaguucucuagagaug

SEQ ID NO: 11125 - RNA, 18 nt, artificial
  Chemically synthesized
ugcucgagaaugaccagg

SEQ ID NO: 11126 - RNA, 18 nt, artificial
  Chemically synthesized
uggaauuacucacccuua

SEQ ID NO: 11127 - RNA, 18 nt, artificial
  Chemically synthesized
gaagugaaaguaagccuu

SEQ ID NO: 11128 - RNA, 18 nt, artificial
  Chemically synthesized
aaauagaacaugcucgag

SEQ ID NO: 11129 - RNA, 18 nt, artificial
  Chemically synthesized
aaauguggucaaggagca

SEQ ID NO: 11130 - RNA, 18 nt, artificial
  Chemically synthesized
cagucaucaaguagaauu

SEQ ID NO: 11131 - RNA, 18 nt, artificial
  Chemically synthesized
aguugacacugagagagg

SEQ ID NO: 11132 - RNA, 18 nt, artificial
  Chemically synthesized
uucauaggguucagggac

SEQ ID NO: 11133 - RNA, 18 nt, artificial
  Chemically synthesized
accuucugcaggacaaug

SEQ ID NO: 11134 - RNA, 18 nt, artificial
  Chemically synthesized
agaaaagucuuuuacccu

SEQ ID NO: 11135 - RNA, 18 nt, artificial
  Chemically synthesized
cuucugugagcagcagug

SEQ ID NO: 11136 - RNA, 18 nt, artificial
  Chemically synthesized
uaacuuuggaaugacauc

SEQ ID NO: 11137 - RNA, 18 nt, artificial
  Chemically synthesized
guaaaugagguuucugag

SEQ ID NO: 11138 - RNA, 18 nt, artificial
  Chemically synthesized
acauggaaacacacccag

SEQ ID NO: 11139 - RNA, 18 nt, artificial
  Chemically synthesized
acaagccauugaagaugc

SEQ ID NO: 11140 - RNA, 18 nt, artificial
  Chemically synthesized
uuucaaugcugcuuucau

SEQ ID NO: 11141 - RNA, 18 nt, artificial
  Chemically synthesized
gagauucagagguccauc

SEQ ID NO: 11142 - RNA, 18 nt, artificial
  Chemically synthesized
augcuguuggagacaacu

SEQ ID NO: 11143 - RNA, 18 nt, artificial
  Chemically synthesized
agagguggcuuaggcucu

SEQ ID NO: 11144 - RNA, 18 nt, artificial
  Chemically synthesized
cacacagcccugauaggg

SEQ ID NO: 11145 - RNA, 18 nt, artificial
  Chemically synthesized
ugagacauggaaacacac

SEQ ID NO: 11146 - RNA, 18 nt, artificial
  Chemically synthesized
cauugcaggaaacucugg

SEQ ID NO: 11147 - RNA, 18 nt, artificial
  Chemically synthesized
acaggugauauucaaacu

SEQ ID NO: 11148 - RNA, 18 nt, artificial
  Chemically synthesized
aauucucccagaaccaaa

SEQ ID NO: 11149 - RNA, 18 nt, artificial
  Chemically synthesized
auaaacuucugcugcaac

SEQ ID NO: 11150 - RNA, 18 nt, artificial
  Chemically synthesized
caugagacauggaaacac

SEQ ID NO: 11151 - RNA, 18 nt, artificial
  Chemically synthesized
auccagauguucuaguug

SEQ ID NO: 11152 - RNA, 18 nt, artificial
  Chemically synthesized
caauuagacaacucccua

SEQ ID NO: 11153 - RNA, 18 nt, artificial
  Chemically synthesized
uacuacaagcacacugag

SEQ ID NO: 11154 - RNA, 18 nt, artificial
  Chemically synthesized
accucuguaaggagacag

SEQ ID NO: 11155 - RNA, 18 nt, artificial
  Chemically synthesized
aacucugguguucacaag

SEQ ID NO: 11156 - RNA, 18 nt, artificial
  Chemically synthesized
guuccuguuuuuuggaag

SEQ ID NO: 11157 - RNA, 18 nt, artificial
  Chemically synthesized
agacaacugcuccaguug

SEQ ID NO: 11158 - RNA, 18 nt, artificial
  Chemically synthesized
cagggaaaaugaagaaac

SEQ ID NO: 11159 - RNA, 18 nt, artificial
  Chemically synthesized
gagaacucaucucaaaca

SEQ ID NO: 11160 - RNA, 18 nt, artificial
  Chemically synthesized
ucuuguugcuggaaaggu

SEQ ID NO: 11161 - RNA, 18 nt, artificial
  Chemically synthesized
agucauuacuuaguaggc

SEQ ID NO: 11162 - RNA, 18 nt, artificial
  Chemically synthesized
caaguuuccuucauuucu

SEQ ID NO: 11163 - RNA, 18 nt, artificial
  Chemically synthesized
aacucagcacaggcaugc

SEQ ID NO: 11164 - RNA, 18 nt, artificial
  Chemically synthesized
cuucugaaaaagcauucc

SEQ ID NO: 11165 - RNA, 18 nt, artificial
  Chemically synthesized
aauccagauguucuaguu

SEQ ID NO: 11166 - RNA, 18 nt, artificial
  Chemically synthesized
aaauaaacuucugcugca

SEQ ID NO: 11167 - RNA, 18 nt, artificial
  Chemically synthesized
acucugaaacacucagua

SEQ ID NO: 11168 - RNA, 18 nt, artificial
  Chemically synthesized
auguauacucccugccuu

SEQ ID NO: 11169 - RNA, 18 nt, artificial
  Chemically synthesized
gagagugaguuaaaugcu

SEQ ID NO: 11170 - RNA, 18 nt, artificial
  Chemically synthesized
auaguccagaaaaggcuc

SEQ ID NO: 11171 - RNA, 18 nt, artificial
  Chemically synthesized
acugcuccaguugacacu

SEQ ID NO: 11172 - RNA, 18 nt, artificial
  Chemically synthesized
gauacauagggauaugug

SEQ ID NO: 11173 - RNA, 18 nt, artificial
  Chemically synthesized
uucugcaggacaaugaag

SEQ ID NO: 11174 - RNA, 18 nt, artificial
  Chemically synthesized
gucugagcaaucucauau

SEQ ID NO: 11175 - RNA, 18 nt, artificial
  Chemically synthesized
aucaacuucugaaaaagc

SEQ ID NO: 11176 - RNA, 18 nt, artificial
  Chemically synthesized
uucaauugucuggauuuc

SEQ ID NO: 11177 - RNA, 18 nt, artificial
  Chemically synthesized
gcucugugaagauaucug

SEQ ID NO: 11178 - RNA, 18 nt, artificial
  Chemically synthesized
ccacaacaaucaccuuuc

SEQ ID NO: 11179 - RNA, 18 nt, artificial
  Chemically synthesized
auaacaaaggcaucauag

SEQ ID NO: 11180 - RNA, 18 nt, artificial
  Chemically synthesized
uuccugcugagaaggcgg

SEQ ID NO: 11181 - RNA, 18 nt, artificial
  Chemically synthesized
guuucugaggcacuggug

SEQ ID NO: 11182 - RNA, 18 nt, artificial
  Chemically synthesized
uagaacccgcaagucugu

SEQ ID NO: 11183 - RNA, 18 nt, artificial
  Chemically synthesized
gaccuugaauacaaguuu

SEQ ID NO: 11184 - RNA, 18 nt, artificial
  Chemically synthesized
uuuuuccucuucagauag

SEQ ID NO: 11185 - RNA, 18 nt, artificial
  Chemically synthesized
gauacaccagcggcucug

SEQ ID NO: 11186 - RNA, 18 nt, artificial
  Chemically synthesized
gcccaagaaguuugaacu

SEQ ID NO: 11187 - RNA, 18 nt, artificial
  Chemically synthesized
agaaaaggcucccagggc

SEQ ID NO: 11188 - RNA, 18 nt, artificial
  Chemically synthesized
uuccuugacugaguuggu

SEQ ID NO: 11189 - RNA, 18 nt, artificial
  Chemically synthesized
cccaggacacuguccucc

SEQ ID NO: 11190 - RNA, 18 nt, artificial
  Chemically synthesized
aacacuucugacuguggu

SEQ ID NO: 11191 - RNA, 18 nt, artificial
  Chemically synthesized
uccacagccaccagcuuc

SEQ ID NO: 11192 - RNA, 18 nt, artificial
  Chemically synthesized
uaugagaaaugucaaggu

SEQ ID NO: 11193 - RNA, 18 nt, artificial
  Chemically synthesized
aacccgcaagucugugca

SEQ ID NO: 11194 - RNA, 18 nt, artificial
  Chemically synthesized
augcggacacacacacuu

SEQ ID NO: 11195 - RNA, 18 nt, artificial
  Chemically synthesized
ggaauuagccacuagacu

SEQ ID NO: 11196 - RNA, 18 nt, artificial
  Chemically synthesized
cuugaguagauaacaaag

SEQ ID NO: 11197 - RNA, 18 nt, artificial
  Chemically synthesized
acgauggacuucuaaacc

SEQ ID NO: 11198 - RNA, 18 nt, artificial
  Chemically synthesized
ucggaauucuucaauggu

SEQ ID NO: 11199 - RNA, 18 nt, artificial
  Chemically synthesized
ucagcacaggcaugcccu

SEQ ID NO: 11200 - RNA, 18 nt, artificial
  Chemically synthesized
cccuuucaauagucacac

SEQ ID NO: 11201 - RNA, 18 nt, artificial
  Chemically synthesized
gacuucuaaaccagccag

SEQ ID NO: 11202 - RNA, 18 nt, artificial
  Chemically synthesized
acuuuuccaaguuuccuu

SEQ ID NO: 11203 - RNA, 18 nt, artificial
  Chemically synthesized
uacaagcacacugaggac

SEQ ID NO: 11204 - RNA, 18 nt, artificial
  Chemically synthesized
uucagauagauguugcuu

SEQ ID NO: 11205 - RNA, 18 nt, artificial
  Chemically synthesized
uggauuucacaccuccac

SEQ ID NO: 11206 - RNA, 18 nt, artificial
  Chemically synthesized
ccuuuugagagauuugag

SEQ ID NO: 11207 - RNA, 18 nt, artificial
  Chemically synthesized
aaacucugguguucacaa

SEQ ID NO: 11208 - RNA, 18 nt, artificial
  Chemically synthesized
cacuucugacugugguca

SEQ ID NO: 11209 - RNA, 18 nt, artificial
  Chemically synthesized
acuucugaaaaagcauuc

SEQ ID NO: 11210 - RNA, 18 nt, artificial
  Chemically synthesized
agaagaaaacgccugcag

SEQ ID NO: 11211 - RNA, 18 nt, artificial
  Chemically synthesized
aacacucaguaacaaaca

SEQ ID NO: 11212 - RNA, 18 nt, artificial
  Chemically synthesized
caucauccucacugcuuc

SEQ ID NO: 11213 - RNA, 18 nt, artificial
  Chemically synthesized
aaaauagaacaugcucga

SEQ ID NO: 11214 - RNA, 18 nt, artificial
  Chemically synthesized
ugaaaaagcauucccacc

SEQ ID NO: 11215 - RNA, 18 nt, artificial
  Chemically synthesized
auucuuuucugggaaccu

SEQ ID NO: 11216 - RNA, 18 nt, artificial
  Chemically synthesized
caacaggaaacagcaaug

SEQ ID NO: 11217 - RNA, 18 nt, artificial
  Chemically synthesized
gauuucacaccuccacgc

SEQ ID NO: 11218 - RNA, 18 nt, artificial
  Chemically synthesized
auacaccagcggcucugg

SEQ ID NO: 11219 - RNA, 18 nt, artificial
  Chemically synthesized
caggaagcggaaauuuuc

SEQ ID NO: 11220 - RNA, 18 nt, artificial
  Chemically synthesized
guguauucaaagcaguuc

SEQ ID NO: 11221 - RNA, 18 nt, artificial
  Chemically synthesized
ucuguaaggagacagacu

SEQ ID NO: 11222 - RNA, 18 nt, artificial
  Chemically synthesized
cagcaauguauacucccu

SEQ ID NO: 11223 - RNA, 18 nt, artificial
  Chemically synthesized
caaccuuagcauucugga

SEQ ID NO: 11224 - RNA, 18 nt, artificial
  Chemically synthesized
cacugagagagguccagg

SEQ ID NO: 11225 - RNA, 18 nt, artificial
  Chemically synthesized
caguggcuaaagaaacag

SEQ ID NO: 11226 - RNA, 18 nt, artificial
  Chemically synthesized
auacuuuaugcagccagc

SEQ ID NO: 11227 - RNA, 18 nt, artificial
  Chemically synthesized
uuccauucguucaacuuc

SEQ ID NO: 11228 - RNA, 18 nt, artificial
  Chemically synthesized
ucugugucucccuaaaga

SEQ ID NO: 11229 - RNA, 18 nt, artificial
  Chemically synthesized
aauguugccauccgaaau

SEQ ID NO: 11230 - RNA, 18 nt, artificial
  Chemically synthesized
acugcagucaucaaguag

SEQ ID NO: 11231 - RNA, 18 nt, artificial
  Chemically synthesized
cuggcuugaguagauaac

SEQ ID NO: 11232 - RNA, 18 nt, artificial
  Chemically synthesized
uaaguaugcuaaucggaa

SEQ ID NO: 11233 - RNA, 18 nt, artificial
  Chemically synthesized
agcucagaucuaaauacu

SEQ ID NO: 11234 - RNA, 18 nt, artificial
  Chemically synthesized
gcuuuuauggaaaccuuc

SEQ ID NO: 11235 - RNA, 18 nt, artificial
  Chemically synthesized
gagacuacuguacaagca

SEQ ID NO: 11236 - RNA, 18 nt, artificial
  Chemically synthesized
agcaaccuuugaaacuca

SEQ ID NO: 11237 - RNA, 18 nt, artificial
  Chemically synthesized
aaaugguuuuaugauggc

SEQ ID NO: 11238 - RNA, 18 nt, artificial
  Chemically synthesized
acucugguguucacaagu

SEQ ID NO: 11239 - RNA, 18 nt, artificial
  Chemically synthesized
ugaaaacucacucauuug

SEQ ID NO: 11240 - RNA, 18 nt, artificial
  Chemically synthesized
agccuuuugagagauuug

SEQ ID NO: 11241 - RNA, 18 nt, artificial
  Chemically synthesized
auaccagcacgacugcuc

SEQ ID NO: 11242 - RNA, 18 nt, artificial
  Chemically synthesized
uggguuccuugacugagu

SEQ ID NO: 11243 - RNA, 18 nt, artificial
  Chemically synthesized
aaacucaagccauuucua

SEQ ID NO: 11244 - RNA, 18 nt, artificial
  Chemically synthesized
gauuggucagauuagaaa

SEQ ID NO: 11245 - RNA, 18 nt, artificial
  Chemically synthesized
aaaccaaacacacucuga

SEQ ID NO: 11246 - RNA, 18 nt, artificial
  Chemically synthesized
cagauaugaucaugcgga

SEQ ID NO: 11247 - RNA, 18 nt, artificial
  Chemically synthesized
gcuuuucugagucgucuc

SEQ ID NO: 11248 - RNA, 18 nt, artificial
  Chemically synthesized
ggugauauucaaacucag

SEQ ID NO: 11249 - RNA, 18 nt, artificial
  Chemically synthesized
agucauuaugugauugag

SEQ ID NO: 11250 - RNA, 18 nt, artificial
  Chemically synthesized
ccaggacacuguccuccc

SEQ ID NO: 11251 - RNA, 18 nt, artificial
  Chemically synthesized
uccacucuucccaaaaug

SEQ ID NO: 11252 - RNA, 18 nt, artificial
  Chemically synthesized
cauucccaccuuuguugg

SEQ ID NO: 11253 - RNA, 18 nt, artificial
  Chemically synthesized
acugaguugguugaaaug

SEQ ID NO: 11254 - RNA, 18 nt, artificial
  Chemically synthesized
ggaaggucaaguuucuca

SEQ ID NO: 11255 - RNA, 18 nt, artificial
  Chemically synthesized
gaccagaacugcuacaac

SEQ ID NO: 11256 - RNA, 18 nt, artificial
  Chemically synthesized
aaguguuggacccagcug

SEQ ID NO: 11257 - RNA, 18 nt, artificial
  Chemically synthesized
uguguuaaucagguuucc

SEQ ID NO: 11258 - RNA, 18 nt, artificial
  Chemically synthesized
aaugcugcuuucaugaca

SEQ ID NO: 11259 - RNA, 18 nt, artificial
  Chemically synthesized
uucaauggucaaauugca

SEQ ID NO: 11260 - RNA, 18 nt, artificial
  Chemically synthesized
uaaaguucauaggguuca

SEQ ID NO: 11261 - RNA, 18 nt, artificial
  Chemically synthesized
cauccagcagggcuuuuc

SEQ ID NO: 11262 - RNA, 18 nt, artificial
  Chemically synthesized
ggagacuacuguacaagc

SEQ ID NO: 11263 - RNA, 18 nt, artificial
  Chemically synthesized
auuccagacacauuguuu

SEQ ID NO: 11264 - RNA, 18 nt, artificial
  Chemically synthesized
cuuugaaacucaagccau

SEQ ID NO: 11265 - RNA, 18 nt, artificial
  Chemically synthesized
caaaugcacacaucuacu

SEQ ID NO: 11266 - RNA, 18 nt, artificial
  Chemically synthesized
aggaaggucaaguuucuc

SEQ ID NO: 11267 - RNA, 18 nt, artificial
  Chemically synthesized
cauucuuuucugggaacc

SEQ ID NO: 11268 - RNA, 18 nt, artificial
  Chemically synthesized
cacucucuucuauacaga

SEQ ID NO: 11269 - RNA, 18 nt, artificial
  Chemically synthesized
agaggaaggccauggcug

SEQ ID NO: 11270 - RNA, 18 nt, artificial
  Chemically synthesized
caccaaugauggucuuau

SEQ ID NO: 11271 - RNA, 18 nt, artificial
  Chemically synthesized
aguagauaacaaaggcau

SEQ ID NO: 11272 - RNA, 18 nt, artificial
  Chemically synthesized
cuguuggagacaacugcu

SEQ ID NO: 11273 - RNA, 18 nt, artificial
  Chemically synthesized
uaaacuugauaguccaga

SEQ ID NO: 11274 - RNA, 18 nt, artificial
  Chemically synthesized
ugauaacauccacucuuc

SEQ ID NO: 11275 - RNA, 18 nt, artificial
  Chemically synthesized
uggaugaacauucuuuuc

SEQ ID NO: 11276 - RNA, 18 nt, artificial
  Chemically synthesized
gagagguggcuuaggcuc

SEQ ID NO: 11277 - RNA, 18 nt, artificial
  Chemically synthesized
guguugcacauuccauuc

SEQ ID NO: 11278 - RNA, 18 nt, artificial
  Chemically synthesized
acacacccagggauguuc

SEQ ID NO: 11279 - RNA, 18 nt, artificial
  Chemically synthesized
agcaguucugggcuaaag

SEQ ID NO: 11280 - RNA, 18 nt, artificial
  Chemically synthesized
uuaacugaacaaguguug

SEQ ID NO: 11281 - RNA, 18 nt, artificial
  Chemically synthesized
ggucaucccacuuccuuc

SEQ ID NO: 11282 - RNA, 18 nt, artificial
  Chemically synthesized
gaauugccagccauuuuc

SEQ ID NO: 11283 - RNA, 18 nt, artificial
  Chemically synthesized
auaaggccugacaugugg

SEQ ID NO: 11284 - RNA, 18 nt, artificial
  Chemically synthesized
uaaauguugccauccgaa

SEQ ID NO: 11285 - RNA, 18 nt, artificial
  Chemically synthesized
gaauacugaaaacucacu

SEQ ID NO: 11286 - RNA, 18 nt, artificial
  Chemically synthesized
ggucaaguuucucagcuc

SEQ ID NO: 11287 - RNA, 18 nt, artificial
  Chemically synthesized
uucuuuucugggaaccuu

SEQ ID NO: 11288 - RNA, 18 nt, artificial
  Chemically synthesized
uuugagaacagcaaccuu

SEQ ID NO: 11289 - RNA, 18 nt, artificial
  Chemically synthesized
aggcgguacagcuccacc

SEQ ID NO: 11290 - RNA, 18 nt, artificial
  Chemically synthesized
caguuuugacaacugaau

SEQ ID NO: 11291 - RNA, 18 nt, artificial
  Chemically synthesized
uugaaaugcccaccugga

SEQ ID NO: 11292 - RNA, 18 nt, artificial
  Chemically synthesized
caggucugagcaaucuca

SEQ ID NO: 11293 - RNA, 18 nt, artificial
  Chemically synthesized
uuucucccuuccuccuuu

SEQ ID NO: 11294 - RNA, 18 nt, artificial
  Chemically synthesized
gugaguuaaaugcuguug

SEQ ID NO: 11295 - RNA, 18 nt, artificial
  Chemically synthesized
cugccuugaauaccuuca

SEQ ID NO: 11296 - RNA, 18 nt, artificial
  Chemically synthesized
ccugauagggauacauag

SEQ ID NO: 11297 - RNA, 18 nt, artificial
  Chemically synthesized
acucagcacaggcaugcc

SEQ ID NO: 11298 - RNA, 18 nt, artificial
  Chemically synthesized
cucagaaacugccagguc

SEQ ID NO: 11299 - RNA, 18 nt, artificial
  Chemically synthesized
cugcucagaaacugccag

SEQ ID NO: 11300 - RNA, 18 nt, artificial
  Chemically synthesized
aguuaaaugcuguuggag

SEQ ID NO: 11301 - RNA, 18 nt, artificial
  Chemically synthesized
auccagcagggcuuuucu

SEQ ID NO: 11302 - RNA, 18 nt, artificial
  Chemically synthesized
augccauugaaagcaacu

SEQ ID NO: 11303 - RNA, 18 nt, artificial
  Chemically synthesized
ucaacuucugaaaaagca

SEQ ID NO: 11304 - RNA, 18 nt, artificial
  Chemically synthesized
ucuaccauacuuuaugca

SEQ ID NO: 11305 - RNA, 18 nt, artificial
  Chemically synthesized
uacuuuuccauacuuccu

SEQ ID NO: 11306 - RNA, 18 nt, artificial
  Chemically synthesized
cacucuucccaaaaugug

SEQ ID NO: 11307 - RNA, 18 nt, artificial
  Chemically synthesized
uugaugagguaagaguug

SEQ ID NO: 11308 - RNA, 18 nt, artificial
  Chemically synthesized
ucugguccuugauccauu

SEQ ID NO: 11309 - RNA, 18 nt, artificial
  Chemically synthesized
gucaaauugcacaggccc

SEQ ID NO: 11310 - RNA, 18 nt, artificial
  Chemically synthesized
gaaacucugguguucaca

SEQ ID NO: 11311 - RNA, 18 nt, artificial
  Chemically synthesized
ccagcuuucuggucucac

SEQ ID NO: 11312 - RNA, 18 nt, artificial
  Chemically synthesized
cugcuuucaugacaguca

SEQ ID NO: 11313 - RNA, 18 nt, artificial
  Chemically synthesized
uuguuguggcucauauuu

SEQ ID NO: 11314 - RNA, 18 nt, artificial
  Chemically synthesized
caagcacacugaggaccg

SEQ ID NO: 11315 - RNA, 18 nt, artificial
  Chemically synthesized
aagccauuucuacugaga

SEQ ID NO: 11316 - RNA, 18 nt, artificial
  Chemically synthesized
cuuucaaauacacacagc

SEQ ID NO: 11317 - RNA, 18 nt, artificial
  Chemically synthesized
uguucuguuucugaggag

SEQ ID NO: 11318 - RNA, 18 nt, artificial
  Chemically synthesized
ccagaacugcuacaacag

SEQ ID NO: 11319 - RNA, 18 nt, artificial
  Chemically synthesized
ccuucacacguaguucuc

SEQ ID NO: 11320 - RNA, 18 nt, artificial
  Chemically synthesized
gugauaggaauacugaaa

SEQ ID NO: 11321 - RNA, 18 nt, artificial
  Chemically synthesized
uagauaacaaaggcauca

SEQ ID NO: 11322 - RNA, 18 nt, artificial
  Chemically synthesized
agguuucugagugauagg

SEQ ID NO: 11323 - RNA, 18 nt, artificial
  Chemically synthesized
ccuuugaaacucaagcca

SEQ ID NO: 11324 - RNA, 18 nt, artificial
  Chemically synthesized
acagucauuacuuaguag

SEQ ID NO: 11325 - RNA, 18 nt, artificial
  Chemically synthesized
aggcuggaugaacauucu

SEQ ID NO: 11326 - RNA, 18 nt, artificial
  Chemically synthesized
acagcaauugguguauuc

SEQ ID NO: 11327 - RNA, 18 nt, artificial
  Chemically synthesized
acuacuuggaaaaugcug

SEQ ID NO: 11328 - RNA, 18 nt, artificial
  Chemically synthesized
agggcucccagcuuucug

SEQ ID NO: 11329 - RNA, 18 nt, artificial
  Chemically synthesized
gaagugaaagcggcaacc

SEQ ID NO: 11330 - RNA, 18 nt, artificial
  Chemically synthesized
cuacuuggaaaaugcugu

SEQ ID NO: 11331 - RNA, 18 nt, artificial
  Chemically synthesized
ucacuuugagaacagcaa

SEQ ID NO: 11332 - RNA, 18 nt, artificial
  Chemically synthesized
acuuucaaauacacacag

SEQ ID NO: 11333 - RNA, 18 nt, artificial
  Chemically synthesized
ggacaggucuaaagagag

SEQ ID NO: 11334 - RNA, 18 nt, artificial
  Chemically synthesized
uuugaagcacgucuuaaa

SEQ ID NO: 11335 - RNA, 18 nt, artificial
  Chemically synthesized
ucccagcuuucuggucuc

SEQ ID NO: 11336 - RNA, 18 nt, artificial
  Chemically synthesized
uacucccugccuugaaua

SEQ ID NO: 11337 - RNA, 18 nt, artificial
  Chemically synthesized
ucugcacuggaagcuccu

SEQ ID NO: 11338 - RNA, 18 nt, artificial
  Chemically synthesized
uccagauguucuaguugu

SEQ ID NO: 11339 - RNA, 18 nt, artificial
  Chemically synthesized
ugcccugcuuaucugaag

SEQ ID NO: 11340 - RNA, 18 nt, artificial
  Chemically synthesized
uuuacuagcucauuccuu

SEQ ID NO: 11341 - RNA, 18 nt, artificial
  Chemically synthesized
aguuagaagaagaaaacg

SEQ ID NO: 11342 - RNA, 18 nt, artificial
  Chemically synthesized
gaggaaguuagaagaaga

SEQ ID NO: 11343 - RNA, 18 nt, artificial
  Chemically synthesized
gugugaguaugagaaaug

SEQ ID NO: 11344 - RNA, 18 nt, artificial
  Chemically synthesized
cagcaagaagcaucaggu

SEQ ID NO: 11345 - RNA, 18 nt, artificial
  Chemically synthesized
uuguggcucauauuuagu

SEQ ID NO: 11346 - RNA, 18 nt, artificial
  Chemically synthesized
cacuuauaaggaaacgua

SEQ ID NO: 11347 - RNA, 18 nt, artificial
  Chemically synthesized
cagccagaccuugaauac

SEQ ID NO: 11348 - RNA, 18 nt, artificial
  Chemically synthesized
ugauaagaccaggaagcg

SEQ ID NO: 11349 - RNA, 18 nt, artificial
  Chemically synthesized
ugagcaaucucauauuca

SEQ ID NO: 11350 - RNA, 18 nt, artificial
  Chemically synthesized
cacucugaaacacucagu

SEQ ID NO: 11351 - RNA, 18 nt, artificial
  Chemically synthesized
gacacuguccucccacuc

SEQ ID NO: 11352 - RNA, 18 nt, artificial
  Chemically synthesized
caugauaagaccaggaag

SEQ ID NO: 11353 - RNA, 18 nt, artificial
  Chemically synthesized
ugaaaguaagccuuuuga

SEQ ID NO: 11354 - RNA, 18 nt, artificial
  Chemically synthesized
gaacugcuacaacagaua

SEQ ID NO: 11355 - RNA, 18 nt, artificial
  Chemically synthesized
uggcuuaggcucugauau

SEQ ID NO: 11356 - RNA, 18 nt, artificial
  Chemically synthesized
acuguccaaauuuacagu

SEQ ID NO: 11357 - RNA, 18 nt, artificial
  Chemically synthesized
auuggaaugcuggaaauc

SEQ ID NO: 11358 - RNA, 18 nt, artificial
  Chemically synthesized
uccugauuguccuuuucu

SEQ ID NO: 11359 - RNA, 18 nt, artificial
  Chemically synthesized
aucucaaacagccauaga

SEQ ID NO: 11360 - RNA, 18 nt, artificial
  Chemically synthesized
cuggaugaacauucuuuu

SEQ ID NO: 11361 - RNA, 18 nt, artificial
  Chemically synthesized
accuuuguuggaagugaa

SEQ ID NO: 11362 - RNA, 18 nt, artificial
  Chemically synthesized
ucauccucacugcuucug

SEQ ID NO: 11363 - RNA, 18 nt, artificial
  Chemically synthesized
cagugagaaggguacagg

SEQ ID NO: 11364 - RNA, 18 nt, artificial
  Chemically synthesized
aagguccaagugcucuag

SEQ ID NO: 11365 - RNA, 18 nt, artificial
  Chemically synthesized
ucccuauuuccucauuuc

SEQ ID NO: 11366 - RNA, 18 nt, artificial
  Chemically synthesized
ugaccaggaugguuguga

SEQ ID NO: 11367 - RNA, 18 nt, artificial
  Chemically synthesized
aaggcaucauagauguuu

SEQ ID NO: 11368 - RNA, 18 nt, artificial
  Chemically synthesized
ugguugucccaaaaucac

SEQ ID NO: 11369 - RNA, 18 nt, artificial
  Chemically synthesized
cuuugaaucuuguugcug

SEQ ID NO: 11370 - RNA, 18 nt, artificial
  Chemically synthesized
agaccaguggcuaaagaa

SEQ ID NO: 11371 - RNA, 18 nt, artificial
  Chemically synthesized
ucccacuuccuuccugcc

SEQ ID NO: 11372 - RNA, 18 nt, artificial
  Chemically synthesized
acacucaguaacaaacac

SEQ ID NO: 11373 - RNA, 18 nt, artificial
  Chemically synthesized
caagcacaagaguagaga

SEQ ID NO: 11374 - RNA, 18 nt, artificial
  Chemically synthesized
gaguugaaaugacuuucu

SEQ ID NO: 11375 - RNA, 18 nt, artificial
  Chemically synthesized
acucaguaacaaacacuu

SEQ ID NO: 11376 - RNA, 18 nt, artificial
  Chemically synthesized
ucaucgagguaguagucu

SEQ ID NO: 11377 - RNA, 18 nt, artificial
  Chemically synthesized
augauaacauccacucuu

SEQ ID NO: 11378 - RNA, 18 nt, artificial
  Chemically synthesized
aggacacuguccucccac

SEQ ID NO: 11379 - RNA, 18 nt, artificial
  Chemically synthesized
uccagaaaaggcucccag

SEQ ID NO: 11380 - RNA, 18 nt, artificial
  Chemically synthesized
aacugcuccaguugacac

SEQ ID NO: 11381 - RNA, 18 nt, artificial
  Chemically synthesized
aguugguugaaaugccca

SEQ ID NO: 11382 - RNA, 18 nt, artificial
  Chemically synthesized
cccucuagagcagauuug

SEQ ID NO: 11383 - RNA, 18 nt, artificial
  Chemically synthesized
uagaacuuauagaccaga

SEQ ID NO: 11384 - RNA, 18 nt, artificial
  Chemically synthesized
ugagguaagaguugaaau

SEQ ID NO: 11385 - RNA, 18 nt, artificial
  Chemically synthesized
uuaaaugcuguuggagac

SEQ ID NO: 11386 - RNA, 18 nt, artificial
  Chemically synthesized
uuuucugggaaccuucuu

SEQ ID NO: 11387 - RNA, 18 nt, artificial
  Chemically synthesized
auccauuucaaauggaug

SEQ ID NO: 11388 - RNA, 18 nt, artificial
  Chemically synthesized
acuguggucauauuucca

SEQ ID NO: 11389 - RNA, 18 nt, artificial
  Chemically synthesized
agaaguuguuguggcuca

SEQ ID NO: 11390 - RNA, 18 nt, artificial
  Chemically synthesized
uugcccaacaggaaacag

SEQ ID NO: 11391 - RNA, 18 nt, artificial
  Chemically synthesized
gugcucuagauuggucag

SEQ ID NO: 11392 - RNA, 18 nt, artificial
  Chemically synthesized
gacauggaaacacaccca

SEQ ID NO: 11393 - RNA, 18 nt, artificial
  Chemically synthesized
aaugcuguaguuccuguu

SEQ ID NO: 11394 - RNA, 18 nt, artificial
  Chemically synthesized
cuuuaugcagccagcaag

SEQ ID NO: 11395 - RNA, 18 nt, artificial
  Chemically synthesized
auccuggcuugaguagau

SEQ ID NO: 11396 - RNA, 18 nt, artificial
  Chemically synthesized
ccaaacacacucugaaac

SEQ ID NO: 11397 - RNA, 18 nt, artificial
  Chemically synthesized
cuggcaucauccucacug

SEQ ID NO: 11398 - RNA, 18 nt, artificial
  Chemically synthesized
uaaaugagguuucugagu

SEQ ID NO: 11399 - RNA, 18 nt, artificial
  Chemically synthesized
gcacaagaguagagaacu

SEQ ID NO: 11400 - RNA, 18 nt, artificial
  Chemically synthesized
aaugcguggcucgcuauc

SEQ ID NO: 11401 - RNA, 18 nt, artificial
  Chemically synthesized
ccucuagcccaaauuguc

SEQ ID NO: 11402 - RNA, 18 nt, artificial
  Chemically synthesized
cauucaaaagacucagga

SEQ ID NO: 11403 - RNA, 18 nt, artificial
  Chemically synthesized
gaacagcaaccuuugaaa

SEQ ID NO: 11404 - RNA, 18 nt, artificial
  Chemically synthesized
uguacaagcacaagagua

SEQ ID NO: 11405 - RNA, 18 nt, artificial
  Chemically synthesized
aaugcuguuggagacaac

SEQ ID NO: 11406 - RNA, 18 nt, artificial
  Chemically synthesized
aagcuagacuacuuggaa

SEQ ID NO: 11407 - RNA, 18 nt, artificial
  Chemically synthesized
aggcagacaucauccugg

SEQ ID NO: 11408 - RNA, 18 nt, artificial
  Chemically synthesized
caucaaacaucacuuguu

SEQ ID NO: 11409 - RNA, 18 nt, artificial
  Chemically synthesized
guaccugaagacuggaga

SEQ ID NO: 11410 - RNA, 18 nt, artificial
  Chemically synthesized
caggaaacagcaauguau

SEQ ID NO: 11411 - RNA, 18 nt, artificial
  Chemically synthesized
aaagucuuuuacccuuuc

SEQ ID NO: 11412 - RNA, 18 nt, artificial
  Chemically synthesized
caacagauacuacaagca

SEQ ID NO: 11413 - RNA, 18 nt, artificial
  Chemically synthesized
ucaggaaaagaacaaugu

SEQ ID NO: 11414 - RNA, 18 nt, artificial
  Chemically synthesized
cacucaccagggaaaaug

SEQ ID NO: 11415 - RNA, 18 nt, artificial
  Chemically synthesized
ccagcuucuguaaacuug

SEQ ID NO: 11416 - RNA, 18 nt, artificial
  Chemically synthesized
gcacgucuuaaacaaccu

SEQ ID NO: 11417 - RNA, 18 nt, artificial
  Chemically synthesized
uacuuuaggcugguuguc

SEQ ID NO: 11418 - RNA, 18 nt, artificial
  Chemically synthesized
gcaauguauacucccugc

SEQ ID NO: 11419 - RNA, 18 nt, artificial
  Chemically synthesized
auggucuuauucaucuga

SEQ ID NO: 11420 - RNA, 18 nt, artificial
  Chemically synthesized
acucaaggcuugguagau

SEQ ID NO: 11421 - RNA, 18 nt, artificial
  Chemically synthesized
agccauagacauccauuu

SEQ ID NO: 11422 - RNA, 18 nt, artificial
  Chemically synthesized
gggaauaaagucucugua

SEQ ID NO: 11423 - RNA, 18 nt, artificial
  Chemically synthesized
aaaaagugaacacccagu

SEQ ID NO: 11424 - RNA, 18 nt, artificial
  Chemically synthesized
cugaacaaguguuggacc

SEQ ID NO: 11425 - RNA, 18 nt, artificial
  Chemically synthesized
uagcauuuauucccucug

SEQ ID NO: 11426 - RNA, 18 nt, artificial
  Chemically synthesized
auccuggcaucauccuca

SEQ ID NO: 11427 - RNA, 18 nt, artificial
  Chemically synthesized
guagagagguggcuuagg

SEQ ID NO: 11428 - RNA, 18 nt, artificial
  Chemically synthesized
caagaaguuugaacucau

SEQ ID NO: 11429 - RNA, 18 nt, artificial
  Chemically synthesized
ucuagcauuuauucccuc

SEQ ID NO: 11430 - RNA, 18 nt, artificial
  Chemically synthesized
agccauugaagaugccau

SEQ ID NO: 11431 - RNA, 18 nt, artificial
  Chemically synthesized
agcacacugaggaccgac

SEQ ID NO: 11432 - RNA, 18 nt, artificial
  Chemically synthesized
uacagcuccaccugcugc

SEQ ID NO: 11433 - RNA, 18 nt, artificial
  Chemically synthesized
ugguugugagcauguguu

SEQ ID NO: 11434 - RNA, 18 nt, artificial
  Chemically synthesized
uugugagcauguguuaau

SEQ ID NO: 11435 - RNA, 18 nt, artificial
  Chemically synthesized
uuaucugaagguguugca

SEQ ID NO: 11436 - RNA, 18 nt, artificial
  Chemically synthesized
ucagcucugugaagauau

SEQ ID NO: 11437 - RNA, 18 nt, artificial
  Chemically synthesized
cagccaccagcuucugua

SEQ ID NO: 11438 - RNA, 18 nt, artificial
  Chemically synthesized
cuguggucauauuuccag

SEQ ID NO: 11439 - RNA, 18 nt, artificial
  Chemically synthesized
agugagaaggguacaggg

SEQ ID NO: 11440 - RNA, 18 nt, artificial
  Chemically synthesized
aagagauucagaggucca

SEQ ID NO: 11441 - RNA, 18 nt, artificial
  Chemically synthesized
aaugcaccugguuggaua

SEQ ID NO: 11442 - RNA, 18 nt, artificial
  Chemically synthesized
caagugcucuagauuggu

SEQ ID NO: 11443 - RNA, 18 nt, artificial
  Chemically synthesized
aggucugagcaaucucau

SEQ ID NO: 11444 - RNA, 18 nt, artificial
  Chemically synthesized
gcaucuugcaucaggagc

SEQ ID NO: 11445 - RNA, 18 nt, artificial
  Chemically synthesized
aacugcuacaacagauac

SEQ ID NO: 11446 - RNA, 18 nt, artificial
  Chemically synthesized
agugacaaagugacagag

SEQ ID NO: 11447 - RNA, 18 nt, artificial
  Chemically synthesized
auguugccauccgaaauu

SEQ ID NO: 11448 - RNA, 18 nt, artificial
  Chemically synthesized
gaaauccagauguucuag

SEQ ID NO: 11449 - RNA, 18 nt, artificial
  Chemically synthesized
gagguaguagucuaagua

SEQ ID NO: 11450 - RNA, 18 nt, artificial
  Chemically synthesized
accacaacaaucaccuuu

SEQ ID NO: 11451 - RNA, 18 nt, artificial
  Chemically synthesized
augacuuucuuugucaug

SEQ ID NO: 11452 - RNA, 18 nt, artificial
  Chemically synthesized
cugagaaggcgguacagc

SEQ ID NO: 11453 - RNA, 18 nt, artificial
  Chemically synthesized
aacucuggugugaguaug

SEQ ID NO: 11454 - RNA, 18 nt, artificial
  Chemically synthesized
uuaaucagguuuccuuag

SEQ ID NO: 11455 - RNA, 18 nt, artificial
  Chemically synthesized
ucgagguaguagucuaag

SEQ ID NO: 11456 - RNA, 18 nt, artificial
  Chemically synthesized
uccagcagggcuuuucug

SEQ ID NO: 11457 - RNA, 18 nt, artificial
  Chemically synthesized
uaugugcacaaaugcaca

SEQ ID NO: 11458 - RNA, 18 nt, artificial
  Chemically synthesized
uucagacacuuauaagga

SEQ ID NO: 11459 - RNA, 18 nt, artificial
  Chemically synthesized
uguaaucaagaaccugga

SEQ ID NO: 11460 - RNA, 18 nt, artificial
  Chemically synthesized
auaucuggaaggaaguuu

SEQ ID NO: 11461 - RNA, 18 nt, artificial
  Chemically synthesized
ugcuggaaauccagaugu

SEQ ID NO: 11462 - RNA, 18 nt, artificial
  Chemically synthesized
augcccaccuggaagacu

SEQ ID NO: 11463 - RNA, 18 nt, artificial
  Chemically synthesized
acaacugcuccaguugac

SEQ ID NO: 11464 - RNA, 18 nt, artificial
  Chemically synthesized
uucucccagaaccaaacg

SEQ ID NO: 11465 - RNA, 18 nt, artificial
  Chemically synthesized
acacugagagagguccag

SEQ ID NO: 11466 - RNA, 18 nt, artificial
  Chemically synthesized
gcgaggcagacaucaucc

SEQ ID NO: 11467 - RNA, 18 nt, artificial
  Chemically synthesized
cauggaaacacacccagg

SEQ ID NO: 11468 - RNA, 18 nt, artificial
  Chemically synthesized
caagcaaagucauucuga

SEQ ID NO: 11469 - RNA, 18 nt, artificial
  Chemically synthesized
aguaugagaaaugucaag

SEQ ID NO: 11470 - RNA, 18 nt, artificial
  Chemically synthesized
aaacucagcacaggcaug

SEQ ID NO: 11471 - RNA, 18 nt, artificial
  Chemically synthesized
cuggaaagaauugccagc

SEQ ID NO: 11472 - RNA, 18 nt, artificial
  Chemically synthesized
uuagcagcccugcauauc

SEQ ID NO: 11473 - RNA, 18 nt, artificial
  Chemically synthesized
ugcucuagauuggucaga

SEQ ID NO: 11474 - RNA, 18 nt, artificial
  Chemically synthesized
cagauguucuaguuguuc

SEQ ID NO: 11475 - RNA, 18 nt, artificial
  Chemically synthesized
uuugaaacucaagccauu

SEQ ID NO: 11476 - RNA, 18 nt, artificial
  Chemically synthesized
agucauucugaguaagau

SEQ ID NO: 11477 - RNA, 18 nt, artificial
  Chemically synthesized
ugcuacaacagauacuac

SEQ ID NO: 11478 - RNA, 18 nt, artificial
  Chemically synthesized
aacagauacuacaagcac

SEQ ID NO: 11479 - RNA, 18 nt, artificial
  Chemically synthesized
agcucugugaagauaucu

SEQ ID NO: 11480 - RNA, 18 nt, artificial
  Chemically synthesized
uggacaagccauugaaga

SEQ ID NO: 11481 - RNA, 18 nt, artificial
  Chemically synthesized
cauccuguacccacuguu

SEQ ID NO: 11482 - RNA, 18 nt, artificial
  Chemically synthesized
aaaugcccaccuggaaga

SEQ ID NO: 11483 - RNA, 18 nt, artificial
  Chemically synthesized
gauuggauaagauuguga

SEQ ID NO: 11484 - RNA, 18 nt, artificial
  Chemically synthesized
aggaaacucugguguuca

SEQ ID NO: 11485 - RNA, 18 nt, artificial
  Chemically synthesized
auaagauugugagccaca

SEQ ID NO: 11486 - RNA, 18 nt, artificial
  Chemically synthesized
ucccagccaucugugucu

SEQ ID NO: 11487 - RNA, 18 nt, artificial
  Chemically synthesized
augcguggcucgcuauca

SEQ ID NO: 11488 - RNA, 18 nt, artificial
  Chemically synthesized
gguguugcacauuccauu

SEQ ID NO: 11489 - RNA, 18 nt, artificial
  Chemically synthesized
cuuaugaagccuaauuuc

SEQ ID NO: 11490 - RNA, 18 nt, artificial
  Chemically synthesized
aaaagacucaggaaaaga

SEQ ID NO: 11491 - RNA, 18 nt, artificial
  Chemically synthesized
uccaugauaagaccagga

SEQ ID NO: 11492 - RNA, 18 nt, artificial
  Chemically synthesized
aaaagugaacacccaguu

SEQ ID NO: 11493 - RNA, 18 nt, artificial
  Chemically synthesized
ugauguuggcagcaaugg

SEQ ID NO: 11494 - RNA, 18 nt, artificial
  Chemically synthesized
caagucugugcaauaaau

SEQ ID NO: 11495 - RNA, 18 nt, artificial
  Chemically synthesized
uguugcacauuccauucg

SEQ ID NO: 11496 - RNA, 18 nt, artificial
  Chemically synthesized
cuggugucuucucuuccu

SEQ ID NO: 11497 - RNA, 18 nt, artificial
  Chemically synthesized
uggauguauucuucaaga

SEQ ID NO: 11498 - RNA, 18 nt, artificial
  Chemically synthesized
cauuccauucguucaacu

SEQ ID NO: 11499 - RNA, 18 nt, artificial
  Chemically synthesized
acacacuuucaaauacac

SEQ ID NO: 11500 - RNA, 18 nt, artificial
  Chemically synthesized
ugggacaccacaacaauc

SEQ ID NO: 11501 - RNA, 18 nt, artificial
  Chemically synthesized
aguccucauccuggcuug

SEQ ID NO: 11502 - RNA, 18 nt, artificial
  Chemically synthesized
uagcuucauucagacaua

SEQ ID NO: 11503 - RNA, 18 nt, artificial
  Chemically synthesized
uuauucaucugacaggug

SEQ ID NO: 11504 - RNA, 18 nt, artificial
  Chemically synthesized
ucaucucaaacagccaua

SEQ ID NO: 11505 - RNA, 18 nt, artificial
  Chemically synthesized
ugaaaagaaguuguugug

SEQ ID NO: 11506 - RNA, 18 nt, artificial
  Chemically synthesized
ugacagucauuacuuagu

SEQ ID NO: 11507 - RNA, 18 nt, artificial
  Chemically synthesized
ucaccagggaaaaugaag

SEQ ID NO: 11508 - RNA, 18 nt, artificial
  Chemically synthesized
ccacuuccuuccugccuc

SEQ ID NO: 11509 - RNA, 18 nt, artificial
  Chemically synthesized
ggcuuuucugagucgucu

SEQ ID NO: 11510 - RNA, 18 nt, artificial
  Chemically synthesized
cucaugguaauaacacca

SEQ ID NO: 11511 - RNA, 18 nt, artificial
  Chemically synthesized
gacuguaaucaagaaccu

SEQ ID NO: 11512 - RNA, 18 nt, artificial
  Chemically synthesized
aacuugaugagguaagag

SEQ ID NO: 11513 - RNA, 18 nt, artificial
  Chemically synthesized
agauacaccagcggcucu

SEQ ID NO: 11514 - RNA, 18 nt, artificial
  Chemically synthesized
aagccauugaagaugcca

SEQ ID NO: 11515 - RNA, 18 nt, artificial
  Chemically synthesized
agacaucauccuggcauc

SEQ ID NO: 11516 - RNA, 18 nt, artificial
  Chemically synthesized
caaauuguccaugauaag

SEQ ID NO: 11517 - RNA, 18 nt, artificial
  Chemically synthesized
caacugaauuuuguuguc

SEQ ID NO: 11518 - RNA, 18 nt, artificial
  Chemically synthesized
aaugauaacauccacucu

SEQ ID NO: 11519 - RNA, 18 nt, artificial
  Chemically synthesized
cauacuuuaugcagccag

SEQ ID NO: 11520 - RNA, 18 nt, artificial
  Chemically synthesized
agcugaaauggaggcacc

SEQ ID NO: 11521 - RNA, 18 nt, artificial
  Chemically synthesized
ugcguggcucgcuaucac

SEQ ID NO: 11522 - RNA, 18 nt, artificial
  Chemically synthesized
uuaugugauugagacugu

SEQ ID NO: 11523 - RNA, 18 nt, artificial
  Chemically synthesized
aagaaaacgccugcagac

SEQ ID NO: 11524 - RNA, 18 nt, artificial
  Chemically synthesized
uggcaucauccucacugc

SEQ ID NO: 11525 - RNA, 18 nt, artificial
  Chemically synthesized
ucucccuaaagagauuca

SEQ ID NO: 11526 - RNA, 18 nt, artificial
  Chemically synthesized
acacaucuacuuucacua

SEQ ID NO: 11527 - RNA, 18 nt, artificial
  Chemically synthesized
gguccaggaaggucaagu

SEQ ID NO: 11528 - RNA, 18 nt, artificial
  Chemically synthesized
ccaggucugagcaaucuc

SEQ ID NO: 11529 - RNA, 18 nt, artificial
  Chemically synthesized
auuucucccuuccuccuu

SEQ ID NO: 11530 - RNA, 18 nt, artificial
  Chemically synthesized
uggacuuuuguuucucua

SEQ ID NO: 11531 - RNA, 18 nt, artificial
  Chemically synthesized
gggaaguucucuagagau

SEQ ID NO: 11532 - RNA, 18 nt, artificial
  Chemically synthesized
gaaccuggagggaguuca

SEQ ID NO: 11533 - RNA, 18 nt, artificial
  Chemically synthesized
acaucgagugacaaagug

SEQ ID NO: 11534 - RNA, 18 nt, artificial
  Chemically synthesized
cugcucaaaccaaacaca

SEQ ID NO: 11535 - RNA, 18 nt, artificial
  Chemically synthesized
agggacaggucuaaagag

SEQ ID NO: 11536 - RNA, 18 nt, artificial
  Chemically synthesized
ugaucaugcggacacaca

SEQ ID NO: 11537 - RNA, 18 nt, artificial
  Chemically synthesized
aauuagccacuagacuuu

SEQ ID NO: 11538 - RNA, 18 nt, artificial
  Chemically synthesized
ugccucugguccuugauc

SEQ ID NO: 11539 - RNA, 18 nt, artificial
  Chemically synthesized
auuccauucguucaacuu

SEQ ID NO: 11540 - RNA, 18 nt, artificial
  Chemically synthesized
cuggaaauccagauguuc

SEQ ID NO: 11541 - RNA, 18 nt, artificial
  Chemically synthesized
caaugucucuuucuguuu

SEQ ID NO: 11542 - RNA, 18 nt, artificial
  Chemically synthesized
ugugagcagcaguggccc

SEQ ID NO: 11543 - RNA, 18 nt, artificial
  Chemically synthesized
gucugaccgagcaguuuc

SEQ ID NO: 11544 - RNA, 18 nt, artificial
  Chemically synthesized
uaagauugugagccacau

SEQ ID NO: 11545 - RNA, 18 nt, artificial
  Chemically synthesized
cacaagaguagagaacuc

SEQ ID NO: 11546 - RNA, 18 nt, artificial
  Chemically synthesized
gagacagacuuaaaaugg

SEQ ID NO: 11547 - RNA, 18 nt, artificial
  Chemically synthesized
cucuguaaggagacagac

SEQ ID NO: 11548 - RNA, 18 nt, artificial
  Chemically synthesized
aauaccuucacacguagu

SEQ ID NO: 11549 - RNA, 18 nt, artificial
  Chemically synthesized
aagcauucccaccuuugu

SEQ ID NO: 11550 - RNA, 18 nt, artificial
  Chemically synthesized
cuuuuccauacuuccuug

SEQ ID NO: 11551 - RNA, 18 nt, artificial
  Chemically synthesized
auaaaguucauaggguuc

SEQ ID NO: 11552 - RNA, 18 nt, artificial
  Chemically synthesized
cuaaagagauucagaggu

SEQ ID NO: 11553 - RNA, 18 nt, artificial
  Chemically synthesized
ggagaggaaguuagaaga

SEQ ID NO: 11554 - RNA, 18 nt, artificial
  Chemically synthesized
agccauuucuacugagau

SEQ ID NO: 11555 - RNA, 18 nt, artificial
  Chemically synthesized
augguugugagcaugugu

SEQ ID NO: 11556 - RNA, 18 nt, artificial
  Chemically synthesized
ucaaacagccauagacau

SEQ ID NO: 11557 - RNA, 18 nt, artificial
  Chemically synthesized
aguuucucagcucuguga

SEQ ID NO: 11558 - RNA, 18 nt, artificial
  Chemically synthesized
aaggcgguacagcuccac

SEQ ID NO: 11559 - RNA, 18 nt, artificial
  Chemically synthesized
cagcagggcuuuucugag

SEQ ID NO: 11560 - RNA, 18 nt, artificial
  Chemically synthesized
aucuucaauugucuggau

SEQ ID NO: 11561 - RNA, 18 nt, artificial
  Chemically synthesized
aguuguuguggcucauau

SEQ ID NO: 11562 - RNA, 18 nt, artificial
  Chemically synthesized
gagcugaaauggaggcac

SEQ ID NO: 11563 - RNA, 18 nt, artificial
  Chemically synthesized
ccugcucaaaccaaacac

SEQ ID NO: 11564 - RNA, 18 nt, artificial
  Chemically synthesized
uggaugaagugcugggac

SEQ ID NO: 11565 - RNA, 18 nt, artificial
  Chemically synthesized
cgggaauaaagucucugu

SEQ ID NO: 11566 - RNA, 18 nt, artificial
  Chemically synthesized
acgcaggagaggaaggcc

SEQ ID NO: 11567 - RNA, 18 nt, artificial
  Chemically synthesized
guuguucuaagcccaaga

SEQ ID NO: 11568 - RNA, 18 nt, artificial
  Chemically synthesized
uuggagacaacugcucca

SEQ ID NO: 11569 - RNA, 18 nt, artificial
  Chemically synthesized
cuuucaugacagucauua

SEQ ID NO: 11570 - RNA, 18 nt, artificial
  Chemically synthesized
cagcuucuguaaacuuga

SEQ ID NO: 11571 - RNA, 18 nt, artificial
  Chemically synthesized
auuuauucccucugcacu

SEQ ID NO: 11572 - RNA, 18 nt, artificial
  Chemically synthesized
ccagcaagaagcaucagg

SEQ ID NO: 11573 - RNA, 18 nt, artificial
  Chemically synthesized
acuucuaaaccagccaga

SEQ ID NO: 11574 - RNA, 18 nt, artificial
  Chemically synthesized
ugugucucccuaaagaga

SEQ ID NO: 11575 - RNA, 18 nt, artificial
  Chemically synthesized
augaagugcugggacacc

SEQ ID NO: 11576 - RNA, 18 nt, artificial
  Chemically synthesized
agcauguguuaaucaggu

SEQ ID NO: 11577 - RNA, 18 nt, artificial
  Chemically synthesized
uuccagacacauuguuuu

SEQ ID NO: 11578 - RNA, 18 nt, artificial
  Chemically synthesized
ccuucugcaggacaauga

SEQ ID NO: 11579 - RNA, 18 nt, artificial
  Chemically synthesized
acugagagagguccagga

SEQ ID NO: 11580 - RNA, 18 nt, artificial
  Chemically synthesized
uguaaacuugauagucca

SEQ ID NO: 11581 - RNA, 18 nt, artificial
  Chemically synthesized
gucuuuuacccuuucaau

SEQ ID NO: 11582 - RNA, 18 nt, artificial
  Chemically synthesized
ugauuguccuuuucuuga

SEQ ID NO: 11583 - RNA, 18 nt, artificial
  Chemically synthesized
ccaccuggaagacucugu

SEQ ID NO: 11584 - RNA, 18 nt, artificial
  Chemically synthesized
gucucacgcaggagagga

SEQ ID NO: 11585 - RNA, 18 nt, artificial
  Chemically synthesized
augauuuaccauccagca

SEQ ID NO: 11586 - RNA, 18 nt, artificial
  Chemically synthesized
acuggacaagccauugaa

SEQ ID NO: 11587 - RNA, 18 nt, artificial
  Chemically synthesized
acaaugaagaugauacca

SEQ ID NO: 11588 - RNA, 18 nt, artificial
  Chemically synthesized
agugauaggaauacugaa

SEQ ID NO: 11589 - RNA, 18 nt, artificial
  Chemically synthesized
guagaucaacuucugaaa

SEQ ID NO: 11590 - RNA, 18 nt, artificial
  Chemically synthesized
ugcaacucauuucaugag

SEQ ID NO: 11591 - RNA, 18 nt, artificial
  Chemically synthesized
aagucauucugaguaaga

SEQ ID NO: 11592 - RNA, 18 nt, artificial
  Chemically synthesized
cugcuuaucugaaggugu

SEQ ID NO: 11593 - RNA, 18 nt, artificial
  Chemically synthesized
aguuucugaggcacuggu

SEQ ID NO: 11594 - RNA, 18 nt, artificial
  Chemically synthesized
agucuuuuacccuuucaa

SEQ ID NO: 11595 - RNA, 18 nt, artificial
  Chemically synthesized
cugcuacaacagauacua

SEQ ID NO: 11596 - RNA, 18 nt, artificial
  Chemically synthesized
caguuucugaggcacugg

SEQ ID NO: 11597 - RNA, 18 nt, artificial
  Chemically synthesized
cuggaaagguccaagugc

SEQ ID NO: 11598 - RNA, 18 nt, artificial
  Chemically synthesized
aggaagcggaaauuuucu

SEQ ID NO: 11599 - RNA, 18 nt, artificial
  Chemically synthesized
aucuuguugcuggaaagg

SEQ ID NO: 11600 - RNA, 18 nt, artificial
  Chemically synthesized
agaaaugccucaggaggu

SEQ ID NO: 11601 - RNA, 18 nt, artificial
  Chemically synthesized
acuggaagcuccuugaga

SEQ ID NO: 11602 - RNA, 18 nt, artificial
  Chemically synthesized
ggagguuuuuauuuuucc

SEQ ID NO: 11603 - RNA, 18 nt, artificial
  Chemically synthesized
aagguguugcacauucca

SEQ ID NO: 11604 - RNA, 18 nt, artificial
  Chemically synthesized
aaagguccaagugcucua

SEQ ID NO: 11605 - RNA, 18 nt, artificial
  Chemically synthesized
caagaguagagaacucau

SEQ ID NO: 11606 - RNA, 18 nt, artificial
  Chemically synthesized
caaagugacagaguguac

SEQ ID NO: 11607 - RNA, 18 nt, artificial
  Chemically synthesized
ugcauaucuagugcacca

SEQ ID NO: 11608 - RNA, 18 nt, artificial
  Chemically synthesized
ugaagugcugggacacca

SEQ ID NO: 11609 - RNA, 18 nt, artificial
  Chemically synthesized
uuucugaggaggcuggau

SEQ ID NO: 11610 - RNA, 18 nt, artificial
  Chemically synthesized
auagaacaugcucgagaa

SEQ ID NO: 11611 - RNA, 18 nt, artificial
  Chemically synthesized
aaauuggaaugcuggaaa

SEQ ID NO: 11612 - RNA, 18 nt, artificial
  Chemically synthesized
ucaagaaccuggagggag

SEQ ID NO: 11613 - RNA, 18 nt, artificial
  Chemically synthesized
aacucaaggcuugguaga

SEQ ID NO: 11614 - RNA, 18 nt, artificial
  Chemically synthesized
aucaagaaaaggugaccu

SEQ ID NO: 11615 - RNA, 18 nt, artificial
  Chemically synthesized
gucaaguuucucagcucu

SEQ ID NO: 11616 - RNA, 18 nt, artificial
  Chemically synthesized
aaagacucaggaaaagaa

SEQ ID NO: 11617 - RNA, 18 nt, artificial
  Chemically synthesized
cucauuucaugaggucac

SEQ ID NO: 11618 - RNA, 18 nt, artificial
  Chemically synthesized
uuucacaccuccacgcag

SEQ ID NO: 11619 - RNA, 18 nt, artificial
  Chemically synthesized
gccacuagacuuuaaccu

SEQ ID NO: 11620 - RNA, 18 nt, artificial
  Chemically synthesized
ucauuucaugaggucacc

SEQ ID NO: 11621 - RNA, 18 nt, artificial
  Chemically synthesized
ugugaaugcguggcucgc

SEQ ID NO: 11622 - RNA, 18 nt, artificial
  Chemically synthesized
gaagucauuaugugauug

SEQ ID NO: 11623 - RNA, 18 nt, artificial
  Chemically synthesized
caaacacacucugaaaca

SEQ ID NO: 11624 - RNA, 18 nt, artificial
  Chemically synthesized
gaucaacuucugaaaaag

SEQ ID NO: 11625 - RNA, 18 nt, artificial
  Chemically synthesized
cagcggcucuggaugaag

SEQ ID NO: 11626 - RNA, 18 nt, artificial
  Chemically synthesized
aacgauggacuucuaaac

SEQ ID NO: 11627 - RNA, 18 nt, artificial
  Chemically synthesized
ugugaagauaucuggaag

SEQ ID NO: 11628 - RNA, 18 nt, artificial
  Chemically synthesized
cagagcugaaauggaggc

SEQ ID NO: 11629 - RNA, 18 nt, artificial
  Chemically synthesized
accgacacaccaaugaug

SEQ ID NO: 11630 - RNA, 18 nt, artificial
  Chemically synthesized
cugcagucaucaaguaga

SEQ ID NO: 11631 - RNA, 18 nt, artificial
  Chemically synthesized
ccgagcaguuucugaggc

SEQ ID NO: 11632 - RNA, 18 nt, artificial
  Chemically synthesized
aacuucugcugcaacuca

SEQ ID NO: 11633 - RNA, 18 nt, artificial
  Chemically synthesized
uaucuagugcaccaugga

SEQ ID NO: 11634 - RNA, 18 nt, artificial
  Chemically synthesized
aucagagucccagccagg

SEQ ID NO: 11635 - RNA, 18 nt, artificial
  Chemically synthesized
gacaagccauugaagaug

SEQ ID NO: 11636 - RNA, 18 nt, artificial
  Chemically synthesized
gaagcuccuugagauuag

SEQ ID NO: 11637 - RNA, 18 nt, artificial
  Chemically synthesized
agcuccuugagauuagca

SEQ ID NO: 11638 - RNA, 18 nt, artificial
  Chemically synthesized
acuucugacuguggucau

SEQ ID NO: 11639 - RNA, 18 nt, artificial
  Chemically synthesized
auacuuuaggcugguugu

SEQ ID NO: 11640 - RNA, 18 nt, artificial
  Chemically synthesized
cagacuuaaaauggaagg

SEQ ID NO: 11641 - RNA, 18 nt, artificial
  Chemically synthesized
guaugcuaaucggaauuc

SEQ ID NO: 11642 - RNA, 18 nt, artificial
  Chemically synthesized
aaaaugcuguaguuccug

SEQ ID NO: 11643 - RNA, 18 nt, artificial
  Chemically synthesized
cacacugaggaccgacac

SEQ ID NO: 11644 - RNA, 18 nt, artificial
  Chemically synthesized
gaccugcucaaaccaaac

SEQ ID NO: 11645 - RNA, 18 nt, artificial
  Chemically synthesized
auguggucaaggagcauu

SEQ ID NO: 11646 - RNA, 18 nt, artificial
  Chemically synthesized
cuuccuuccugccucuag

SEQ ID NO: 11647 - RNA, 18 nt, artificial
  Chemically synthesized
gagugaguuaaaugcugu

SEQ ID NO: 11648 - RNA, 18 nt, artificial
  Chemically synthesized
gcagggucuucuccaccu

SEQ ID NO: 11649 - RNA, 18 nt, artificial
  Chemically synthesized
aacugccaggucugagca

SEQ ID NO: 11650 - RNA, 18 nt, artificial
  Chemically synthesized
uauuagcuuauaggcaag

SEQ ID NO: 11651 - RNA, 18 nt, artificial
  Chemically synthesized
gucauucugaguaagauu

SEQ ID NO: 11652 - RNA, 18 nt, artificial
  Chemically synthesized
ucugacaggugauauuca

SEQ ID NO: 11653 - RNA, 18 nt, artificial
  Chemically synthesized
uuaggaauuagccacuag

SEQ ID NO: 11654 - RNA, 18 nt, artificial
  Chemically synthesized
gcuuaggcucugauaugc

SEQ ID NO: 11655 - RNA, 18 nt, artificial
  Chemically synthesized
uaucaccgucugaccgag

SEQ ID NO: 11656 - RNA, 18 nt, artificial
  Chemically synthesized
acuacuguacaagcacaa

SEQ ID NO: 11657 - RNA, 18 nt, artificial
  Chemically synthesized
cuaaagaaacagcaagag

SEQ ID NO: 11658 - RNA, 18 nt, artificial
  Chemically synthesized
aaaugcuguaguuccugu

SEQ ID NO: 11659 - RNA, 18 nt, artificial
  Chemically synthesized
gaugccauugaaagcaac

SEQ ID NO: 11660 - RNA, 18 nt, artificial
  Chemically synthesized
ugccaggucugagcaauc

SEQ ID NO: 11661 - RNA, 18 nt, artificial
  Chemically synthesized
ucuggugugaguaugaga

SEQ ID NO: 11662 - RNA, 18 nt, artificial
  Chemically synthesized
agugaacacccaguucag

SEQ ID NO: 11663 - RNA, 18 nt, artificial
  Chemically synthesized
aagucuuuuacccuuuca

SEQ ID NO: 11664 - RNA, 18 nt, artificial
  Chemically synthesized
ugagagagguccaggaag

SEQ ID NO: 11665 - RNA, 18 nt, artificial
  Chemically synthesized
acugcucagaaacugcca

SEQ ID NO: 11666 - RNA, 18 nt, artificial
  Chemically synthesized
uauacucccugccuugaa

SEQ ID NO: 11667 - RNA, 18 nt, artificial
  Chemically synthesized
uccacgcagggcucccag

SEQ ID NO: 11668 - RNA, 18 nt, artificial
  Chemically synthesized
aucauccucacugcuucu

SEQ ID NO: 11669 - RNA, 18 nt, artificial
  Chemically synthesized
guagagaacucaucucaa

SEQ ID NO: 11670 - RNA, 18 nt, artificial
  Chemically synthesized
ccugguuggauaaaguuc

SEQ ID NO: 11671 - RNA, 18 nt, artificial
  Chemically synthesized
uuuuccauacuuccuuga

SEQ ID NO: 11672 - RNA, 18 nt, artificial
  Chemically synthesized
uaauaucaucgagguagu

SEQ ID NO: 11673 - RNA, 18 nt, artificial
  Chemically synthesized
caccagcggcucuggaug

SEQ ID NO: 11674 - RNA, 18 nt, artificial
  Chemically synthesized
cucaguaacaaacacuuc

SEQ ID NO: 11675 - RNA, 18 nt, artificial
  Chemically synthesized
uguggucauauuuccagu

SEQ ID NO: 11676 - RNA, 18 nt, artificial
  Chemically synthesized
gugcugggacaccacaac

SEQ ID NO: 11677 - RNA, 18 nt, artificial
  Chemically synthesized
cucuaccauacuuuaugc

SEQ ID NO: 11678 - RNA, 18 nt, artificial
  Chemically synthesized
gauguucuaguuguucua

SEQ ID NO: 11679 - RNA, 18 nt, artificial
  Chemically synthesized
cuuccugccucuagccca

SEQ ID NO: 11680 - RNA, 18 nt, artificial
  Chemically synthesized
cccaucuucaauugucug

SEQ ID NO: 11681 - RNA, 18 nt, artificial
  Chemically synthesized
cauaucuagugcaccaug

SEQ ID NO: 11682 - RNA, 18 nt, artificial
  Chemically synthesized
aagugaaagcggcaaccu

SEQ ID NO: 11683 - RNA, 18 nt, artificial
  Chemically synthesized
cuacuguacaagcacaag

SEQ ID NO: 11684 - RNA, 18 nt, artificial
  Chemically synthesized
ugaggcacuggugucuuc

SEQ ID NO: 11685 - RNA, 18 nt, artificial
  Chemically synthesized
agauagauguugcuuccu

SEQ ID NO: 11686 - RNA, 18 nt, artificial
  Chemically synthesized
ggcuugguagaucaacuu

SEQ ID NO: 11687 - RNA, 18 nt, artificial
  Chemically synthesized
gagcagauuugucaaacu

SEQ ID NO: 11688 - RNA, 18 nt, artificial
  Chemically synthesized
ugaaagcggcaaccuuag

SEQ ID NO: 11689 - RNA, 18 nt, artificial
  Chemically synthesized
cuggaagcuccuugagau

SEQ ID NO: 11690 - RNA, 18 nt, artificial
  Chemically synthesized
augauguuggcagcaaug

SEQ ID NO: 11691 - RNA, 18 nt, artificial
  Chemically synthesized
uccaaugaaaagaaguug

SEQ ID NO: 11692 - RNA, 18 nt, artificial
  Chemically synthesized
gucgucuccagaagaugu

SEQ ID NO: 11693 - RNA, 18 nt, artificial
  Chemically synthesized
ggauaugugcacaaaugc

SEQ ID NO: 11694 - RNA, 18 nt, artificial
  Chemically synthesized
acagauacuacaagcaca

SEQ ID NO: 11695 - RNA, 18 nt, artificial
  Chemically synthesized
ucccuaaagagauucaga

SEQ ID NO: 11696 - RNA, 18 nt, artificial
  Chemically synthesized
cauugcccaacaggaaac

SEQ ID NO: 11697 - RNA, 18 nt, artificial
  Chemically synthesized
uccaccuucugcaggaca

SEQ ID NO: 11698 - RNA, 18 nt, artificial
  Chemically synthesized
uggagggaguucagacac

SEQ ID NO: 11699 - RNA, 18 nt, artificial
  Chemically synthesized
acauuccauucguucaac

SEQ ID NO: 11700 - RNA, 18 nt, artificial
  Chemically synthesized
ccuugaauacaaguuuuc

SEQ ID NO: 11701 - RNA, 18 nt, artificial
  Chemically synthesized
uucauggaugauguuggc

SEQ ID NO: 11702 - RNA, 18 nt, artificial
  Chemically synthesized
uucuggauuccaugauuu

SEQ ID NO: 11703 - RNA, 18 nt, artificial
  Chemically synthesized
caucgagugacaaaguga

SEQ ID NO: 11704 - RNA, 18 nt, artificial
  Chemically synthesized
ucacccuagaccugcuca

SEQ ID NO: 11705 - RNA, 18 nt, artificial
  Chemically synthesized
caccagcuucuguaaacu

SEQ ID NO: 11706 - RNA, 18 nt, artificial
  Chemically synthesized
ucugugaagauaucugga

SEQ ID NO: 11707 - RNA, 18 nt, artificial
  Chemically synthesized
cuguuccuucuggauucc

SEQ ID NO: 11708 - RNA, 18 nt, artificial
  Chemically synthesized
gcuggaugaacauucuuu

SEQ ID NO: 11709 - RNA, 18 nt, artificial
  Chemically synthesized
aaaggugaccuccugagg

SEQ ID NO: 11710 - RNA, 18 nt, artificial
  Chemically synthesized
ucaagaaaaggugaccuc

SEQ ID NO: 11711 - RNA, 18 nt, artificial
  Chemically synthesized
gccauuucuacugagauc

SEQ ID NO: 11712 - RNA, 18 nt, artificial
  Chemically synthesized
ugccucuagcccaaauug

SEQ ID NO: 11713 - RNA, 18 nt, artificial
  Chemically synthesized
aaugcccaccuggaagac

SEQ ID NO: 11714 - RNA, 18 nt, artificial
  Chemically synthesized
ugacagaguguacuuuuc

SEQ ID NO: 11715 - RNA, 18 nt, artificial
  Chemically synthesized
cacuuucaaauacacaca

SEQ ID NO: 11716 - RNA, 18 nt, artificial
  Chemically synthesized
agagcugccucugguccu

SEQ ID NO: 11717 - RNA, 18 nt, artificial
  Chemically synthesized
cugguugucccaaaauca

SEQ ID NO: 11718 - RNA, 18 nt, artificial
  Chemically synthesized
cucuggaugaagugcugg

SEQ ID NO: 11719 - RNA, 18 nt, artificial
  Chemically synthesized
auggaugauguuggcagc

SEQ ID NO: 11720 - RNA, 18 nt, artificial
  Chemically synthesized
ucugaagguguugcacau

SEQ ID NO: 11721 - RNA, 18 nt, artificial
  Chemically synthesized
agcaaagucauucugagu

SEQ ID NO: 11722 - RNA, 18 nt, artificial
  Chemically synthesized
cuugaugagguaagaguu

SEQ ID NO: 11723 - RNA, 18 nt, artificial
  Chemically synthesized
cgauggacuucuaaacca

SEQ ID NO: 11724 - RNA, 18 nt, artificial
  Chemically synthesized
agguaaaugagguuucug

SEQ ID NO: 11725 - RNA, 18 nt, artificial
  Chemically synthesized
acuucgagacuggacaag

SEQ ID NO: 11726 - RNA, 18 nt, artificial
  Chemically synthesized
caucauccuggcaucauc

SEQ ID NO: 11727 - RNA, 18 nt, artificial
  Chemically synthesized
ugcacaaaugcacacauc

SEQ ID NO: 11728 - RNA, 18 nt, artificial
  Chemically synthesized
acagacuuaaaauggaag

SEQ ID NO: 11729 - RNA, 18 nt, artificial
  Chemically synthesized
auguucuguuucugagga

SEQ ID NO: 11730 - RNA, 18 nt, artificial
  Chemically synthesized
cagaguguacuuuuccau

SEQ ID NO: 11731 - RNA, 18 nt, artificial
  Chemically synthesized
ucuucccaaaaugugguc

SEQ ID NO: 11732 - RNA, 18 nt, artificial
  Chemically synthesized
uucuggacuuuuguuucu

SEQ ID NO: 11733 - RNA, 18 nt, artificial
  Chemically synthesized
gaaacacacccagggaug

SEQ ID NO: 11734 - RNA, 18 nt, artificial
  Chemically synthesized
aaguuuugagauguccaa

SEQ ID NO: 11735 - RNA, 18 nt, artificial
  Chemically synthesized
ucccacuccagguaagug

SEQ ID NO: 11736 - RNA, 18 nt, artificial
  Chemically synthesized
ugauuuaccauccagcag

SEQ ID NO: 11737 - RNA, 18 nt, artificial
  Chemically synthesized
agaaccaaacgauggacu

SEQ ID NO: 11738 - RNA, 18 nt, artificial
  Chemically synthesized
gaaaaagugaacacccag

SEQ ID NO: 11739 - RNA, 18 nt, artificial
  Chemically synthesized
ugagucgucuccagaaga

SEQ ID NO: 11740 - RNA, 18 nt, artificial
  Chemically synthesized
gauaagauugugagccac

SEQ ID NO: 11741 - RNA, 18 nt, artificial
  Chemically synthesized
caaaggcaucauagaugu

SEQ ID NO: 11742 - RNA, 18 nt, artificial
  Chemically synthesized
aauugcauccuguaccca

SEQ ID NO: 11743 - RNA, 18 nt, artificial
  Chemically synthesized
uacaagcacaagaguaga

SEQ ID NO: 11744 - RNA, 18 nt, artificial
  Chemically synthesized
uccagguaaguguuccug

SEQ ID NO: 11745 - RNA, 18 nt, artificial
  Chemically synthesized
ucugagcaaucucauauu

SEQ ID NO: 11746 - RNA, 18 nt, artificial
  Chemically synthesized
aguuuugagauguccaau

SEQ ID NO: 11747 - RNA, 18 nt, artificial
  Chemically synthesized
aagugaaaguaagccuuu

SEQ ID NO: 11748 - RNA, 18 nt, artificial
  Chemically synthesized
aguaugcuaaucggaauu

SEQ ID NO: 11749 - RNA, 18 nt, artificial
  Chemically synthesized
gucaauaauaucaucgag

SEQ ID NO: 11750 - RNA, 18 nt, artificial
  Chemically synthesized
uccucauccuggcuugag

SEQ ID NO: 11751 - RNA, 18 nt, artificial
  Chemically synthesized
guuaaaugcuguuggaga

SEQ ID NO: 11752 - RNA, 18 nt, artificial
  Chemically synthesized
aguguuccugcugagaag

SEQ ID NO: 11753 - RNA, 18 nt, artificial
  Chemically synthesized
cccuuagcauaaggccug

SEQ ID NO: 11754 - RNA, 18 nt, artificial
  Chemically synthesized
aaugcacacaucuacuuu

SEQ ID NO: 11755 - RNA, 18 nt, artificial
  Chemically synthesized
cacgcagggcucccagcu

SEQ ID NO: 11756 - RNA, 18 nt, artificial
  Chemically synthesized
aucaugcggacacacaca

SEQ ID NO: 11757 - RNA, 18 nt, artificial
  Chemically synthesized
ugggaucagagucccagc

SEQ ID NO: 11758 - RNA, 18 nt, artificial
  Chemically synthesized
cgacugcagucaucaagu

SEQ ID NO: 11759 - RNA, 18 nt, artificial
  Chemically synthesized
ccaccagcuucuguaaac

SEQ ID NO: 11760 - RNA, 18 nt, artificial
  Chemically synthesized
cgccugcagaccaguggc

SEQ ID NO: 11761 - RNA, 18 nt, artificial
  Chemically synthesized
auccugauuguccuuuuc

SEQ ID NO: 11762 - RNA, 18 nt, artificial
  Chemically synthesized
ucagguuuccuuaggaau

SEQ ID NO: 11763 - RNA, 18 nt, artificial
  Chemically synthesized
caacucccuauuuccuca

SEQ ID NO: 11764 - RNA, 18 nt, artificial
  Chemically synthesized
acuguccucccacuccag

SEQ ID NO: 11765 - RNA, 18 nt, artificial
  Chemically synthesized
aauacacacagcccugau

SEQ ID NO: 11766 - RNA, 18 nt, artificial
  Chemically synthesized
cuucugcugcaacucauu

SEQ ID NO: 11767 - RNA, 18 nt, artificial
  Chemically synthesized
agagauucagagguccau

SEQ ID NO: 11768 - RNA, 18 nt, artificial
  Chemically synthesized
ucuguagugaaggcagag

SEQ ID NO: 11769 - RNA, 18 nt, artificial
  Chemically synthesized
acuuccaccaagagcugc

SEQ ID NO: 11770 - RNA, 18 nt, artificial
  Chemically synthesized
gcuugguagaucaacuuc

SEQ ID NO: 11771 - RNA, 18 nt, artificial
  Chemically synthesized
gaaucaagaaaaggugac

SEQ ID NO: 11772 - RNA, 18 nt, artificial
  Chemically synthesized
uucugcugcaacucauuu

SEQ ID NO: 11773 - RNA, 18 nt, artificial
  Chemically synthesized
agguguugcacauuccau

SEQ ID NO: 11774 - RNA, 18 nt, artificial
  Chemically synthesized
cucuagauuggucagauu

SEQ ID NO: 11775 - RNA, 18 nt, artificial
  Chemically synthesized
ccugagcagggucuucuc

SEQ ID NO: 11776 - RNA, 18 nt, artificial
  Chemically synthesized
accuccugaggucauccc

SEQ ID NO: 11777 - RNA, 18 nt, artificial
  Chemically synthesized
gagagguccaggaagguc

SEQ ID NO: 11778 - RNA, 18 nt, artificial
  Chemically synthesized
cuccugaggucaucccac

SEQ ID NO: 11779 - RNA, 18 nt, artificial
  Chemically synthesized
aucuacuuucacuaguac

SEQ ID NO: 11780 - RNA, 18 nt, artificial
  Chemically synthesized
uaaauacuuuaggcuggu

SEQ ID NO: 11781 - RNA, 18 nt, artificial
  Chemically synthesized
uguuggacccagcugggc

SEQ ID NO: 11782 - RNA, 18 nt, artificial
  Chemically synthesized
ucgagugacaaagugaca

SEQ ID NO: 11783 - RNA, 18 nt, artificial
  Chemically synthesized
uguccucccacuccaggu

SEQ ID NO: 11784 - RNA, 18 nt, artificial
  Chemically synthesized
uaguuccuguuuuuugga

SEQ ID NO: 11785 - RNA, 18 nt, artificial
  Chemically synthesized
gaagaagaaaacgccugc

SEQ ID NO: 11786 - RNA, 18 nt, artificial
  Chemically synthesized
uuagcuuauaggcaagac

SEQ ID NO: 11787 - RNA, 18 nt, artificial
  Chemically synthesized
caagaaaugccucaggag

SEQ ID NO: 11788 - RNA, 18 nt, artificial
  Chemically synthesized
caccuuuguuggaaguga

SEQ ID NO: 11789 - RNA, 18 nt, artificial
  Chemically synthesized
cacacucugaaacacuca

SEQ ID NO: 11790 - RNA, 18 nt, artificial
  Chemically synthesized
uggauauuugaagcacgu

SEQ ID NO: 11791 - RNA, 18 nt, artificial
  Chemically synthesized
cacacaucuacuuucacu

SEQ ID NO: 11792 - RNA, 18 nt, artificial
  Chemically synthesized
ugguccuugauccauugc

SEQ ID NO: 11793 - RNA, 18 nt, artificial
  Chemically synthesized
aaguacaagcaaagucau

SEQ ID NO: 11794 - RNA, 18 nt, artificial
  Chemically synthesized
agcggcucuggaugaagu

SEQ ID NO: 11795 - RNA, 18 nt, artificial
  Chemically synthesized
uggaaggaaguuuuccug

SEQ ID NO: 11796 - RNA, 18 nt, artificial
  Chemically synthesized
acguaguucuccuggcag

SEQ ID NO: 11797 - RNA, 18 nt, artificial
  Chemically synthesized
ucacgcaggagaggaagg

SEQ ID NO: 11798 - RNA, 18 nt, artificial
  Chemically synthesized
acuuuggaaugacaucga

SEQ ID NO: 11799 - RNA, 18 nt, artificial
  Chemically synthesized
cuuuuauggaaaccuuca

SEQ ID NO: 11800 - RNA, 18 nt, artificial
  Chemically synthesized
gguaagaguugaaaugac

SEQ ID NO: 11801 - RNA, 18 nt, artificial
  Chemically synthesized
agguccaucaaacaucac

SEQ ID NO: 11802 - RNA, 18 nt, artificial
  Chemically synthesized
cugugaaugcguggcucg

SEQ ID NO: 11803 - RNA, 18 nt, artificial
  Chemically synthesized
gaguguacuuuuccauac

SEQ ID NO: 11804 - RNA, 18 nt, artificial
  Chemically synthesized
cugcaacucauuucauga

SEQ ID NO: 11805 - RNA, 18 nt, artificial
  Chemically synthesized
gugucuucucuuccucga

SEQ ID NO: 11806 - RNA, 18 nt, artificial
  Chemically synthesized
aggaugguugugagcaug

SEQ ID NO: 11807 - RNA, 18 nt, artificial
  Chemically synthesized
gcagggcuuuucugaguc

SEQ ID NO: 11808 - RNA, 18 nt, artificial
  Chemically synthesized
agcauucccaccuuuguu

SEQ ID NO: 11809 - RNA, 18 nt, artificial
  Chemically synthesized
ucccaaaaucacuuugag

SEQ ID NO: 11810 - RNA, 18 nt, artificial
  Chemically synthesized
gcggcucuggaugaagug

SEQ ID NO: 11811 - RNA, 18 nt, artificial
  Chemically synthesized
cugcugagaaggcgguac

SEQ ID NO: 11812 - RNA, 18 nt, artificial
  Chemically synthesized
ugcugagaaggcgguaca

SEQ ID NO: 11813 - RNA, 18 nt, artificial
  Chemically synthesized
gucauuaugugauugaga

SEQ ID NO: 11814 - RNA, 18 nt, artificial
  Chemically synthesized
auuuucaagacuucgaga

SEQ ID NO: 11815 - RNA, 18 nt, artificial
  Chemically synthesized
aggagaggaaggccaugg

SEQ ID NO: 11816 - RNA, 18 nt, artificial
  Chemically synthesized
acgacugcagucaucaag

SEQ ID NO: 11817 - RNA, 18 nt, artificial
  Chemically synthesized
gccuuuugagagauuuga

SEQ ID NO: 11818 - RNA, 18 nt, artificial
  Chemically synthesized
augaagaugauaccagca

SEQ ID NO: 11819 - RNA, 18 nt, artificial
  Chemically synthesized
cggcucuggaugaagugc

SEQ ID NO: 11820 - RNA, 18 nt, artificial
  Chemically synthesized
aacaugcucgagaaugac

SEQ ID NO: 11821 - RNA, 18 nt, artificial
  Chemically synthesized
cccauuaauuccagacac

SEQ ID NO: 11822 - RNA, 18 nt, artificial
  Chemically synthesized
gauuugaguuucaaugug

SEQ ID NO: 11823 - RNA, 18 nt, artificial
  Chemically synthesized
acacacacacuuucaaau

SEQ ID NO: 11824 - RNA, 18 nt, artificial
  Chemically synthesized
aggcaucauagauguuuu

SEQ ID NO: 11825 - RNA, 18 nt, artificial
  Chemically synthesized
uucaaaagacucaggaaa

SEQ ID NO: 11826 - RNA, 18 nt, artificial
  Chemically synthesized
uuuuccaaguuuccuuca

SEQ ID NO: 11827 - RNA, 18 nt, artificial
  Chemically synthesized
caccuggaagacucugua

SEQ ID NO: 11828 - RNA, 18 nt, artificial
  Chemically synthesized
uuuuccuggaaagaauug

SEQ ID NO: 11829 - RNA, 18 nt, artificial
  Chemically synthesized
cugggaucagagucccag

SEQ ID NO: 11830 - RNA, 18 nt, artificial
  Chemically synthesized
accaaacgauggacuucu

SEQ ID NO: 11831 - RNA, 18 nt, artificial
  Chemically synthesized
aguuuuccuggaaagaau

SEQ ID NO: 11832 - RNA, 18 nt, artificial
  Chemically synthesized
agguagagagguggcuua

SEQ ID NO: 11833 - RNA, 18 nt, artificial
  Chemically synthesized
cacaggcccucuagagca

SEQ ID NO: 11834 - RNA, 18 nt, artificial
  Chemically synthesized
gucuagcauuuauucccu

SEQ ID NO: 11835 - RNA, 18 nt, artificial
  Chemically synthesized
ccuucauggaugauguug

SEQ ID NO: 11836 - RNA, 18 nt, artificial
  Chemically synthesized
cagccauagacauccauu

SEQ ID NO: 11837 - RNA, 18 nt, artificial
  Chemically synthesized
acaucacuuguucugaaa

SEQ ID NO: 11838 - RNA, 18 nt, artificial
  Chemically synthesized
agauaucuggaaggaagu

SEQ ID NO: 11839 - RNA, 18 nt, artificial
  Chemically synthesized
gguaauuugaaagauugg

SEQ ID NO: 11840 - RNA, 18 nt, artificial
  Chemically synthesized
aagguaaaugagguuucu

SEQ ID NO: 11841 - RNA, 18 nt, artificial
  Chemically synthesized
caagccauugaagaugcc

SEQ ID NO: 11842 - RNA, 18 nt, artificial
  Chemically synthesized
uacuuuaugcagccagca

SEQ ID NO: 11843 - RNA, 18 nt, artificial
  Chemically synthesized
uaaagggugagaggaagu

SEQ ID NO: 11844 - RNA, 18 nt, artificial
  Chemically synthesized
cugcuccaguugacacug

SEQ ID NO: 11845 - RNA, 18 nt, artificial
  Chemically synthesized
cccugugaaugcguggcu

SEQ ID NO: 11846 - RNA, 18 nt, artificial
  Chemically synthesized
gcagagcugaaauggagg

SEQ ID NO: 11847 - RNA, 18 nt, artificial
  Chemically synthesized
agagcugaaauggaggca

SEQ ID NO: 11848 - RNA, 18 nt, artificial
  Chemically synthesized
uagacuuuaaccucugua

SEQ ID NO: 11849 - RNA, 18 nt, artificial
  Chemically synthesized
ccucuagagcagauuugu

SEQ ID NO: 11850 - RNA, 18 nt, artificial
  Chemically synthesized
uacaccagcggcucugga

SEQ ID NO: 11851 - RNA, 18 nt, artificial
  Chemically synthesized
uguuuucaccucuaccau

SEQ ID NO: 11852 - RNA, 18 nt, artificial
  Chemically synthesized
uugcacauuccauucguu

SEQ ID NO: 11853 - RNA, 18 nt, artificial
  Chemically synthesized
cacgucuuaaacaaccuu

SEQ ID NO: 11854 - RNA, 18 nt, artificial
  Chemically synthesized
caaguguuggacccagcu

SEQ ID NO: 11855 - RNA, 18 nt, artificial
  Chemically synthesized
agccagcaagaagcauca

SEQ ID NO: 11856 - RNA, 18 nt, artificial
  Chemically synthesized
ccuggagggaguucagac

SEQ ID NO: 11857 - RNA, 18 nt, artificial
  Chemically synthesized
uaugaucaugcggacaca

SEQ ID NO: 11858 - RNA, 18 nt, artificial
  Chemically synthesized
aacaggaaacagcaaugu

SEQ ID NO: 11859 - RNA, 18 nt, artificial
  Chemically synthesized
ggcgguacagcuccaccu

SEQ ID NO: 11860 - RNA, 18 nt, artificial
  Chemically synthesized
ugugggaaacuguccaaa

SEQ ID NO: 11861 - RNA, 18 nt, artificial
  Chemically synthesized
acaggagaggaaguuaga

SEQ ID NO: 11862 - RNA, 18 nt, artificial
  Chemically synthesized
aagcacaagaguagagaa

SEQ ID NO: 11863 - RNA, 18 nt, artificial
  Chemically synthesized
gguaaaugagguuucuga

SEQ ID NO: 11864 - RNA, 18 nt, artificial
  Chemically synthesized
gacuacuguacaagcaca

SEQ ID NO: 11865 - RNA, 18 nt, artificial
  Chemically synthesized
gcaagacguaaaaaaaug

SEQ ID NO: 11866 - RNA, 18 nt, artificial
  Chemically synthesized
cucuguauuuuagucuag

SEQ ID NO: 11867 - RNA, 18 nt, artificial
  Chemically synthesized
accaaugauggucuuauu

SEQ ID NO: 11868 - RNA, 18 nt, artificial
  Chemically synthesized
ccagccaucugugucucc

SEQ ID NO: 11869 - RNA, 18 nt, artificial
  Chemically synthesized
uagagcagauuugucaaa

SEQ ID NO: 11870 - RNA, 18 nt, artificial
  Chemically synthesized
uucuaagcccaagaaguu

SEQ ID NO: 11871 - RNA, 18 nt, artificial
  Chemically synthesized
uuccaccaagagcugccu

SEQ ID NO: 11872 - RNA, 18 nt, artificial
  Chemically synthesized
caacugcuccaguugaca

SEQ ID NO: 11873 - RNA, 18 nt, artificial
  Chemically synthesized
gaaagguccaagugcucu

SEQ ID NO: 11874 - RNA, 18 nt, artificial
  Chemically synthesized
aaccaaacacacucugaa

SEQ ID NO: 11875 - RNA, 18 nt, artificial
  Chemically synthesized
cucuucccaaaauguggu

SEQ ID NO: 11876 - RNA, 18 nt, artificial
  Chemically synthesized
ugcuuucaugacagucau

SEQ ID NO: 11877 - RNA, 18 nt, artificial
  Chemically synthesized
guuguuguggcucauauu

SEQ ID NO: 11878 - RNA, 18 nt, artificial
  Chemically synthesized
ccacuagacuuuaaccuc

SEQ ID NO: 11879 - RNA, 18 nt, artificial
  Chemically synthesized
cuguuuuuuggaagucau

SEQ ID NO: 11880 - RNA, 18 nt, artificial
  Chemically synthesized
cacuguccucccacucca

SEQ ID NO: 11881 - RNA, 18 nt, artificial
  Chemically synthesized
agcagauuugucaaacuu

SEQ ID NO: 11882 - RNA, 18 nt, artificial
  Chemically synthesized
uagggauacauagggaua

SEQ ID NO: 11883 - RNA, 18 nt, artificial
  Chemically synthesized
uguuccugcugagaaggc

SEQ ID NO: 11884 - RNA, 18 nt, artificial
  Chemically synthesized
gguccaagugcucuagau

SEQ ID NO: 11885 - RNA, 18 nt, artificial
  Chemically synthesized
augcucgagaaugaccag

SEQ ID NO: 11886 - RNA, 18 nt, artificial
  Chemically synthesized
acacagcccugauaggga

SEQ ID NO: 11887 - RNA, 18 nt, artificial
  Chemically synthesized
acuagacuuuaaccucug

SEQ ID NO: 11888 - RNA, 18 nt, artificial
  Chemically synthesized
aaaaggugaccuccugag

SEQ ID NO: 11889 - RNA, 18 nt, artificial
  Chemically synthesized
aaauugcacaggcccucu

SEQ ID NO: 11890 - RNA, 18 nt, artificial
  Chemically synthesized
ccucugcacuggaagcuc

SEQ ID NO: 11891 - RNA, 18 nt, artificial
  Chemically synthesized
guagucuaaguaugcuaa

SEQ ID NO: 11892 - RNA, 18 nt, artificial
  Chemically synthesized
gagguccaucaaacauca

SEQ ID NO: 11893 - RNA, 18 nt, artificial
  Chemically synthesized
cugcuucugugagcagca

SEQ ID NO: 11894 - RNA, 18 nt, artificial
  Chemically synthesized
ccauggcugggaucagag

SEQ ID NO: 11895 - RNA, 18 nt, artificial
  Chemically synthesized
cucaucucaaacagccau

SEQ ID NO: 11896 - RNA, 18 nt, artificial
  Chemically synthesized
auuucacaccuccacgca

SEQ ID NO: 11897 - RNA, 18 nt, artificial
  Chemically synthesized
gggcauuugauguagaac

SEQ ID NO: 11898 - RNA, 18 nt, artificial
  Chemically synthesized
ggcuaaacucuggauggg

SEQ ID NO: 11899 - RNA, 18 nt, artificial
  Chemically synthesized
uaacaaaggcaucauaga

SEQ ID NO: 11900 - RNA, 18 nt, artificial
  Chemically synthesized
aagugacagaguguacuu

SEQ ID NO: 11901 - RNA, 18 nt, artificial
  Chemically synthesized
caccugguuggauaaagu

SEQ ID NO: 11902 - RNA, 18 nt, artificial
  Chemically synthesized
agcuuaugaagccuaauu

SEQ ID NO: 11903 - RNA, 18 nt, artificial
  Chemically synthesized
gagggaucccagccaucu

SEQ ID NO: 11904 - RNA, 18 nt, artificial
  Chemically synthesized
cacuguuccuucuggauu

SEQ ID NO: 11905 - RNA, 18 nt, artificial
  Chemically synthesized
uuucacuaguacaugaga

SEQ ID NO: 11906 - RNA, 18 nt, artificial
  Chemically synthesized
aauugccagccauuuuca

SEQ ID NO: 11907 - RNA, 18 nt, artificial
  Chemically synthesized
accuccacgcagggcucc

SEQ ID NO: 11908 - RNA, 18 nt, artificial
  Chemically synthesized
agcaucaggugaaaauag

SEQ ID NO: 11909 - RNA, 18 nt, artificial
  Chemically synthesized
uguggcagcauuuaauac

SEQ ID NO: 11910 - RNA, 18 nt, artificial
  Chemically synthesized
cuuggaaaaugcuguagu

SEQ ID NO: 11911 - RNA, 18 nt, artificial
  Chemically synthesized
gguagagagguggcuuag

SEQ ID NO: 11912 - RNA, 18 nt, artificial
  Chemically synthesized
uucacaaguacaagcaaa

SEQ ID NO: 11913 - RNA, 18 nt, artificial
  Chemically synthesized
gauaugugcacaaaugca

SEQ ID NO: 11914 - RNA, 18 nt, artificial
  Chemically synthesized
uuuaggcugguuguccca

SEQ ID NO: 11915 - RNA, 18 nt, artificial
  Chemically synthesized
gcccugauagggauacau

SEQ ID NO: 11916 - RNA, 18 nt, artificial
  Chemically synthesized
aggaaacagcaauguaua

SEQ ID NO: 11917 - RNA, 18 nt, artificial
  Chemically synthesized
cagcugggcaagaaaugc

SEQ ID NO: 11918 - RNA, 18 nt, artificial
  Chemically synthesized
guaguucuccuggcagug

SEQ ID NO: 11919 - RNA, 18 nt, artificial
  Chemically synthesized
agaaugaccaggaugguu

SEQ ID NO: 11920 - RNA, 18 nt, artificial
  Chemically synthesized
guccaagugcucuagauu

SEQ ID NO: 11921 - RNA, 18 nt, artificial
  Chemically synthesized
ucuuucuguuuucucugu

SEQ ID NO: 11922 - RNA, 18 nt, artificial
  Chemically synthesized
gggauaugugcacaaaug

SEQ ID NO: 11923 - RNA, 18 nt, artificial
  Chemically synthesized
cccuagaccugcucaaac

SEQ ID NO: 11924 - RNA, 18 nt, artificial
  Chemically synthesized
auucaaaagacucaggaa

SEQ ID NO: 11925 - RNA, 18 nt, artificial
  Chemically synthesized
cagcccugauagggauac

SEQ ID NO: 11926 - RNA, 18 nt, artificial
  Chemically synthesized
uaacaccauugaagcuca

SEQ ID NO: 11927 - RNA, 18 nt, artificial
  Chemically synthesized
aaacgccugcagaccagu

SEQ ID NO: 11928 - RNA, 18 nt, artificial
  Chemically synthesized
auuuaccauccagcaggg

SEQ ID NO: 11929 - RNA, 18 nt, artificial
  Chemically synthesized
agacuggagagugaguua

SEQ ID NO: 11930 - RNA, 18 nt, artificial
  Chemically synthesized
agucagcuuaugaagccu

SEQ ID NO: 11931 - RNA, 18 nt, artificial
  Chemically synthesized
cucuggugugaguaugag

SEQ ID NO: 11932 - RNA, 18 nt, artificial
  Chemically synthesized
cucauccuggcuugagua

SEQ ID NO: 11933 - RNA, 18 nt, artificial
  Chemically synthesized
acagccauagacauccau

SEQ ID NO: 11934 - RNA, 18 nt, artificial
  Chemically synthesized
ccuccacgcagggcuccc

SEQ ID NO: 11935 - RNA, 18 nt, artificial
  Chemically synthesized
augugggaaacuguccaa

SEQ ID NO: 11936 - RNA, 18 nt, artificial
  Chemically synthesized
agggaucccagccaucug

SEQ ID NO: 11937 - RNA, 18 nt, artificial
  Chemically synthesized
gggcuuuucugagucguc

SEQ ID NO: 11938 - RNA, 18 nt, artificial
  Chemically synthesized
agguaguagucuaaguau

SEQ ID NO: 11939 - RNA, 18 nt, artificial
  Chemically synthesized
uuuaucagcccauauguu

SEQ ID NO: 11940 - RNA, 18 nt, artificial
  Chemically synthesized
cuugagauuagcagcccu

SEQ ID NO: 11941 - RNA, 18 nt, artificial
  Chemically synthesized
gcugaaauggaggcaccc

SEQ ID NO: 11942 - RNA, 18 nt, artificial
  Chemically synthesized
cagaccuugaauacaagu

SEQ ID NO: 11943 - RNA, 18 nt, artificial
  Chemically synthesized
acacacacuuucaaauac

SEQ ID NO: 11944 - RNA, 18 nt, artificial
  Chemically synthesized
ccacauuaaguucuuuca

SEQ ID NO: 11945 - RNA, 18 nt, artificial
  Chemically synthesized
gcggaaauuuucuucccg

SEQ ID NO: 11946 - RNA, 18 nt, artificial
  Chemically synthesized
auugcccaacaggaaaca

SEQ ID NO: 11947 - RNA, 18 nt, artificial
  Chemically synthesized
ugaaugcguggcucgcua

SEQ ID NO: 11948 - RNA, 18 nt, artificial
  Chemically synthesized
gucaaaacuaccaaaaug

SEQ ID NO: 11949 - RNA, 18 nt, artificial
  Chemically synthesized
guguuccugcugagaagg

SEQ ID NO: 11950 - RNA, 18 nt, artificial
  Chemically synthesized
ccuaaagagauucagagg

SEQ ID NO: 11951 - RNA, 18 nt, artificial
  Chemically synthesized
gcccugugaaugcguggc

SEQ ID NO: 11952 - RNA, 18 nt, artificial
  Chemically synthesized
agccagaccuugaauaca

SEQ ID NO: 11953 - RNA, 18 nt, artificial
  Chemically synthesized
cauucguucaacuuccac

SEQ ID NO: 11954 - RNA, 18 nt, artificial
  Chemically synthesized
ugccugagcagggucuuc

SEQ ID NO: 11955 - RNA, 18 nt, artificial
  Chemically synthesized
gaagacucuguauuuuag

SEQ ID NO: 11956 - RNA, 18 nt, artificial
  Chemically synthesized
caagagcugccucugguc

SEQ ID NO: 11957 - RNA, 18 nt, artificial
  Chemically synthesized
agaauugccagccauuuu

SEQ ID NO: 11958 - RNA, 18 nt, artificial
  Chemically synthesized
uuguucuaagcccaagaa

SEQ ID NO: 11959 - RNA, 18 nt, artificial
  Chemically synthesized
cacacacuuucaaauaca

SEQ ID NO: 11960 - RNA, 18 nt, artificial
  Chemically synthesized
cuuuggaaugacaucgag

SEQ ID NO: 11961 - RNA, 18 nt, artificial
  Chemically synthesized
caccauugaagcucagau

SEQ ID NO: 11962 - RNA, 18 nt, artificial
  Chemically synthesized
gagacuggacaagccauu

SEQ ID NO: 11963 - RNA, 18 nt, artificial
  Chemically synthesized
uccauuucaaauggaugu

SEQ ID NO: 11964 - RNA, 18 nt, artificial
  Chemically synthesized
aacucauuucaugagguc

SEQ ID NO: 11965 - RNA, 18 nt, artificial
  Chemically synthesized
caacucauuucaugaggu

SEQ ID NO: 11966 - RNA, 18 nt, artificial
  Chemically synthesized
cguggcucgcuaucaccg

SEQ ID NO: 11967 - RNA, 18 nt, artificial
  Chemically synthesized
gacacuuauaaggaaacg

SEQ ID NO: 11968 - RNA, 18 nt, artificial
  Chemically synthesized
caggaaacucugguguuc

SEQ ID NO: 11969 - RNA, 18 nt, artificial
  Chemically synthesized
ucaagguaaaugagguuu

SEQ ID NO: 11970 - RNA, 18 nt, artificial
  Chemically synthesized
auugcacaggcccucuag

SEQ ID NO: 11971 - RNA, 18 nt, artificial
  Chemically synthesized
uuagacaacucccuauuu

SEQ ID NO: 11972 - RNA, 18 nt, artificial
  Chemically synthesized
ggagcauugcccaacagg

SEQ ID NO: 11973 - RNA, 18 nt, artificial
  Chemically synthesized
ugugcacaaaugcacaca

SEQ ID NO: 11974 - RNA, 18 nt, artificial
  Chemically synthesized
aguguacuuuuccauacu

SEQ ID NO: 11975 - RNA, 18 nt, artificial
  Chemically synthesized
gacaacucccuauuuccu

SEQ ID NO: 11976 - RNA, 18 nt, artificial
  Chemically synthesized
ccaagaaguuugaacuca

SEQ ID NO: 11977 - RNA, 18 nt, artificial
  Chemically synthesized
aaauacacacagcccuga

SEQ ID NO: 11978 - RNA, 18 nt, artificial
  Chemically synthesized
cuccagguaaguguuccu

SEQ ID NO: 11979 - RNA, 18 nt, artificial
  Chemically synthesized
ccucuaccauacuuuaug

SEQ ID NO: 11980 - RNA, 18 nt, artificial
  Chemically synthesized
gaaaagaacaaugucucu

SEQ ID NO: 11981 - RNA, 18 nt, artificial
  Chemically synthesized
cuuucuuugucauggguu

SEQ ID NO: 11982 - RNA, 18 nt, artificial
  Chemically synthesized
gacacauuguuuucucaa

SEQ ID NO: 11983 - RNA, 18 nt, artificial
  Chemically synthesized
cucagguaauuugaaaga

SEQ ID NO: 11984 - RNA, 18 nt, artificial
  Chemically synthesized
guagauaacaaaggcauc

SEQ ID NO: 11985 - RNA, 18 nt, artificial
  Chemically synthesized
guucaacuuccaccaaga

SEQ ID NO: 11986 - RNA, 18 nt, artificial
  Chemically synthesized
uagauguuuucaccucua

SEQ ID NO: 11987 - RNA, 18 nt, artificial
  Chemically synthesized
gugcaccauggaauuacu

SEQ ID NO: 11988 - RNA, 18 nt, artificial
  Chemically synthesized
cuguacccacuguuccuu

SEQ ID NO: 11989 - RNA, 18 nt, artificial
  Chemically synthesized
auaggguucagggacagg

SEQ ID NO: 11990 - RNA, 18 nt, artificial
  Chemically synthesized
ccaacaggaaacagcaau

SEQ ID NO: 11991 - RNA, 18 nt, artificial
  Chemically synthesized
gcaaagucauucugagua

SEQ ID NO: 11992 - RNA, 18 nt, artificial
  Chemically synthesized
ccauauguuucuggaauc

SEQ ID NO: 11993 - RNA, 18 nt, artificial
  Chemically synthesized
gcccugcauaucuagugc

SEQ ID NO: 11994 - RNA, 18 nt, artificial
  Chemically synthesized
cacuggaagcuccuugag

SEQ ID NO: 11995 - RNA, 18 nt, artificial
  Chemically synthesized
cugaggucaucccacuuc

SEQ ID NO: 11996 - RNA, 18 nt, artificial
  Chemically synthesized
uuuaccauccagcagggc

SEQ ID NO: 11997 - RNA, 18 nt, artificial
  Chemically synthesized
aaagcaacucugguguga

SEQ ID NO: 11998 - RNA, 18 nt, artificial
  Chemically synthesized
auguucaaucacccuaga

SEQ ID NO: 11999 - RNA, 18 nt, artificial
  Chemically synthesized
ucaagccauuucuacuga

SEQ ID NO: 12000 - RNA, 18 nt, artificial
  Chemically synthesized
guaaguguuccugcugag

SEQ ID NO: 12001 - RNA, 18 nt, artificial
  Chemically synthesized
agcccauauguuucugga

SEQ ID NO: 12002 - RNA, 18 nt, artificial
  Chemically synthesized
ccagaccuugaauacaag

SEQ ID NO: 12003 - RNA, 18 nt, artificial
  Chemically synthesized
ucauccuggcuugaguag

SEQ ID NO: 12004 - RNA, 18 nt, artificial
  Chemically synthesized
cagcaauugguguauuca

SEQ ID NO: 12005 - RNA, 18 nt, artificial
  Chemically synthesized
gcaucauagauguuuuca

SEQ ID NO: 12006 - RNA, 18 nt, artificial
  Chemically synthesized
gaaaaggcucccagggcu

SEQ ID NO: 12007 - RNA, 18 nt, artificial
  Chemically synthesized
ucagagucccagccaggc

SEQ ID NO: 12008 - RNA, 18 nt, artificial
  Chemically synthesized
acucaggaaaagaacaau

SEQ ID NO: 12009 - RNA, 18 nt, artificial
  Chemically synthesized
ccaccuuuguuggaagug

SEQ ID NO: 12010 - RNA, 18 nt, artificial
  Chemically synthesized
acauucuuuucugggaac

SEQ ID NO: 12011 - RNA, 18 nt, artificial
  Chemically synthesized
agauacuacaagcacacu

SEQ ID NO: 12012 - RNA, 18 nt, artificial
  Chemically synthesized
acucauuucaugagguca

SEQ ID NO: 12013 - RNA, 18 nt, artificial
  Chemically synthesized
ucaccuuucggcuuuuau

SEQ ID NO: 12014 - RNA, 18 nt, artificial
  Chemically synthesized
guugucccaaaaucacuu

SEQ ID NO: 12015 - RNA, 18 nt, artificial
  Chemically synthesized
acaucuacuuucacuagu

SEQ ID NO: 12016 - RNA, 18 nt, artificial
  Chemically synthesized
caaaaucacuuugagaac

SEQ ID NO: 12017 - RNA, 18 nt, artificial
  Chemically synthesized
gcggcaaccuuagcauuc

SEQ ID NO: 12018 - RNA, 18 nt, artificial
  Chemically synthesized
caaaauguggucaaggag

SEQ ID NO: 12019 - RNA, 18 nt, artificial
  Chemically synthesized
aacaaguguuggacccag

SEQ ID NO: 12020 - RNA, 18 nt, artificial
  Chemically synthesized
gcuuucuggucucacgca

SEQ ID NO: 12021 - RNA, 18 nt, artificial
  Chemically synthesized
gugaaagcggcaaccuua

SEQ ID NO: 12022 - RNA, 18 nt, artificial
  Chemically synthesized
guucagucaaaacuacca

SEQ ID NO: 12023 - RNA, 18 nt, artificial
  Chemically synthesized
acaaagugacagagugua

SEQ ID NO: 12024 - RNA, 18 nt, artificial
  Chemically synthesized
acguauccaaugaaaaga

SEQ ID NO: 12025 - RNA, 18 nt, artificial
  Chemically synthesized
aacuuuuccaaguuuccu

SEQ ID NO: 12026 - RNA, 18 nt, artificial
  Chemically synthesized
ugggaaacuguccaaauu

SEQ ID NO: 12027 - RNA, 18 nt, artificial
  Chemically synthesized
guguuggacccagcuggg

SEQ ID NO: 12028 - RNA, 18 nt, artificial
  Chemically synthesized
ucccagccaggcgcgagg

SEQ ID NO: 12029 - RNA, 18 nt, artificial
  Chemically synthesized
aaaacgccugcagaccag

SEQ ID NO: 12030 - RNA, 18 nt, artificial
  Chemically synthesized
cacacuuucaaauacaca

SEQ ID NO: 12031 - RNA, 18 nt, artificial
  Chemically synthesized
acagaguguacuuuucca

SEQ ID NO: 12032 - RNA, 18 nt, artificial
  Chemically synthesized
uuacccaguccucauccu

SEQ ID NO: 12033 - RNA, 18 nt, artificial
  Chemically synthesized
ucagcccauauguuucug

SEQ ID NO: 12034 - RNA, 18 nt, artificial
  Chemically synthesized
ucaaauugcacaggcccu

SEQ ID NO: 12035 - RNA, 18 nt, artificial
  Chemically synthesized
caccuccacgcagggcuc

SEQ ID NO: 12036 - RNA, 18 nt, artificial
  Chemically synthesized
cagggucuucuccaccuu

SEQ ID NO: 12037 - RNA, 18 nt, artificial
  Chemically synthesized
ugggaaccuucuuuauaa

SEQ ID NO: 12038 - RNA, 18 nt, artificial
  Chemically synthesized
uagaccugcucaaaccaa

SEQ ID NO: 12039 - RNA, 18 nt, artificial
  Chemically synthesized
gcuucuguaaacuugaua

SEQ ID NO: 12040 - RNA, 18 nt, Artificial Sequence
  Chemically synthesized
uuagcauaaggccugaca

SEQ ID NO: 12041 - RNA, 18 nt, artificial
  Chemically synthesized
cagcaggaacacuuaccu

SEQ ID NO: 12042 - RNA, 18 nt, artificial
  Chemically synthesized
uaucuacucaagccagga

SEQ ID NO: 12043 - RNA, 18 nt, artificial
  Chemically synthesized
aaauggcuggcaauucuu

SEQ ID NO: 12044 - RNA, 18 nt, artificial
  Chemically synthesized
uuaccaugaguucaaacu

SEQ ID NO: 12045 - RNA, 18 nt, artificial
  Chemically synthesized
ucaaacuucuugggcuua

SEQ ID NO: 12046 - RNA, 18 nt, artificial
  Chemically synthesized
agcaggaacacuuaccug

SEQ ID NO: 12047 - RNA, 18 nt, artificial
  Chemically synthesized
aauggcuggcaauucuuu

SEQ ID NO: 12048 - RNA, 18 nt, artificial
  Chemically synthesized
auggcuggcaauucuuuc

SEQ ID NO: 12049 - RNA, 18 nt, artificial
  Chemically synthesized
ucagcucugccuucacua

SEQ ID NO: 12050 - RNA, 18 nt, artificial
  Chemically synthesized
auuaccaugaguucaaac

SEQ ID NO: 12051 - RNA, 18 nt, artificial
  Chemically synthesized
auuguccugcagaaggug

SEQ ID NO: 12052 - RNA, 18 nt, artificial
  Chemically synthesized
uacagcauuuuccaagua

SEQ ID NO: 12053 - RNA, 18 nt, artificial
  Chemically synthesized
gugucccagcacuucauc

SEQ ID NO: 12054 - RNA, 18 nt, artificial
  Chemically synthesized
cuggcugggacucugauc

SEQ ID NO: 12055 - RNA, 18 nt, artificial
  Chemically synthesized
ucaaucucucuuuagacc

SEQ ID NO: 12056 - RNA, 18 nt, artificial
  Chemically synthesized
aacuuuauccaaccaggu

SEQ ID NO: 12057 - RNA, 18 nt, artificial
  Chemically synthesized
auugcucagaccuggcag

SEQ ID NO: 12058 - RNA, 18 nt, artificial
  Chemically synthesized
uuuguuaucuacucaagc

SEQ ID NO: 12059 - RNA, 18 nt, artificial
  Chemically synthesized
gaguucaaacuucuuggg

SEQ ID NO: 12060 - RNA, 18 nt, artificial
  Chemically synthesized
uuuagaucugagcuucaa

SEQ ID NO: 12061 - RNA, 18 nt, artificial
  Chemically synthesized
uaucaucuucauuguccu

SEQ ID NO: 12062 - RNA, 18 nt, artificial
  Chemically synthesized
ucucagcaggaacacuua

SEQ ID NO: 12063 - RNA, 18 nt, artificial
  Chemically synthesized
uauuuucaccugaugcuu

SEQ ID NO: 12064 - RNA, 18 nt, artificial
  Chemically synthesized
auuucagcucugccuuca

SEQ ID NO: 12065 - RNA, 18 nt, artificial
  Chemically synthesized
ucuauuuucaccugaugc

SEQ ID NO: 12066 - RNA, 18 nt, artificial
  Chemically synthesized
aaucucucuuuagaccug

SEQ ID NO: 12067 - RNA, 18 nt, artificial
  Chemically synthesized
uuaauguggcucacaauc

SEQ ID NO: 12068 - RNA, 18 nt, artificial
  Chemically synthesized
auuuucaccugaugcuuc

SEQ ID NO: 12069 - RNA, 18 nt, artificial
  Chemically synthesized
cagcacuucauccagagc

SEQ ID NO: 12070 - RNA, 18 nt, artificial
  Chemically synthesized
uuagaucugagcuucaau

SEQ ID NO: 12071 - RNA, 18 nt, artificial
  Chemically synthesized
gccaggaugaggacuggg

SEQ ID NO: 12072 - RNA, 18 nt, artificial
  Chemically synthesized
aagccaggaugaggacug

SEQ ID NO: 12073 - RNA, 18 nt, artificial
  Chemically synthesized
uucuauuuucaccugaug

SEQ ID NO: 12074 - RNA, 18 nt, artificial
  Chemically synthesized
uucauuguccugcagaag

SEQ ID NO: 12075 - RNA, 18 nt, artificial
  Chemically synthesized
auugcugccaacaucauc

SEQ ID NO: 12076 - RNA, 18 nt, artificial
  Chemically synthesized
uaugagauugcucagacc

SEQ ID NO: 12077 - RNA, 18 nt, artificial
  Chemically synthesized
ucauccagagccgcuggu

SEQ ID NO: 12078 - RNA, 18 nt, artificial
  Chemically synthesized
cgcgccuggcugggacuc

SEQ ID NO: 12079 - RNA, 18 nt, artificial
  Chemically synthesized
ugcugccaacaucaucca

SEQ ID NO: 12080 - RNA, 18 nt, artificial
  Chemically synthesized
agccaggaugaggacugg

SEQ ID NO: 12081 - RNA, 18 nt, artificial
  Chemically synthesized
aauauugacaggaaaccc

SEQ ID NO: 12082 - RNA, 18 nt, artificial
  Chemically synthesized
uugcucagaccuggcagu

SEQ ID NO: 12083 - RNA, 18 nt, artificial
  Chemically synthesized
uagaucugagcuucaaug

SEQ ID NO: 12084 - RNA, 18 nt, artificial
  Chemically synthesized
uuuucaccugaugcuucu

SEQ ID NO: 12085 - RNA, 18 nt, artificial
  Chemically synthesized
cccagccauggccuuccu

SEQ ID NO: 12086 - RNA, 18 nt, artificial
  Chemically synthesized
ucagcaggaacacuuacc

SEQ ID NO: 12087 - RNA, 18 nt, artificial
  Chemically synthesized
uaugaugccuuuguuauc

SEQ ID NO: 12088 - RNA, 18 nt, artificial
  Chemically synthesized
aucccagccauggccuuc

SEQ ID NO: 12089 - RNA, 18 nt, artificial
  Chemically synthesized
uuucagcucugccuucac

SEQ ID NO: 12090 - RNA, 18 nt, artificial
  Chemically synthesized
ucaagccaggaugaggac

SEQ ID NO: 12091 - RNA, 18 nt, artificial
  Chemically synthesized
ucccagccauggccuucc

SEQ ID NO: 12092 - RNA, 18 nt, artificial
  Chemically synthesized
uucauccagagccgcugg

SEQ ID NO: 12093 - RNA, 18 nt, artificial
  Chemically synthesized
agguaaguguuccugcug

SEQ ID NO: 12094 - RNA, 18 nt, artificial
  Chemically synthesized
uccuggcuugaguagaua

SEQ ID NO: 12095 - RNA, 18 nt, artificial
  Chemically synthesized
aagaauugccagccauuu

SEQ ID NO: 12096 - RNA, 18 nt, artificial
  Chemically synthesized
aguuugaacucaugguaa

SEQ ID NO: 12097 - RNA, 18 nt, artificial
  Chemically synthesized
uaagcccaagaaguuuga

SEQ ID NO: 12098 - RNA, 18 nt, artificial
  Chemically synthesized
cagguaaguguuccugcu

SEQ ID NO: 12099 - RNA, 18 nt, artificial
  Chemically synthesized
aaagaauugccagccauu

SEQ ID NO: 12100 - RNA, 18 nt, artificial
  Chemically synthesized
gaaagaauugccagccau

SEQ ID NO: 12101 - RNA, 18 nt, artificial
  Chemically synthesized
uagugaaggcagagcuga

SEQ ID NO: 12102 - RNA, 18 nt, artificial
  Chemically synthesized
guuugaacucaugguaau

SEQ ID NO: 12103 - RNA, 18 nt, artificial
  Chemically synthesized
caccuucugcaggacaau

SEQ ID NO: 12104 - RNA, 18 nt, artificial
  Chemically synthesized
uacuuggaaaaugcugua

SEQ ID NO: 12105 - RNA, 18 nt, artificial
  Chemically synthesized
gaugaagugcugggacac

SEQ ID NO: 12106 - RNA, 18 nt, artificial
  Chemically synthesized
gaucagagucccagccag

SEQ ID NO: 12107 - RNA, 18 nt, artificial
  Chemically synthesized
ggucuaaagagagauuga

SEQ ID NO: 12108 - RNA, 18 nt, artificial
  Chemically synthesized
accugguuggauaaaguu

SEQ ID NO: 12109 - RNA, 18 nt, artificial
  Chemically synthesized
cugccaggucugagcaau

SEQ ID NO: 12110 - RNA, 18 nt, artificial
  Chemically synthesized
gcuugaguagauaacaaa

SEQ ID NO: 12111 - RNA, 18 nt, artificial
  Chemically synthesized
cccaagaaguuugaacuc

SEQ ID NO: 12112 - RNA, 18 nt, artificial
  Chemically synthesized
uugaagcucagaucuaaa

SEQ ID NO: 12113 - RNA, 18 nt, artificial
  Chemically synthesized
aggacaaugaagaugaua

SEQ ID NO: 12114 - RNA, 18 nt, artificial
  Chemically synthesized
uaaguguuccugcugaga

SEQ ID NO: 12115 - RNA, 18 nt, artificial
  Chemically synthesized
aagcaucaggugaaaaua

SEQ ID NO: 12116 - RNA, 18 nt, artificial
  Chemically synthesized
ugaaggcagagcugaaau

SEQ ID NO: 12117 - RNA, 18 nt, artificial
  Chemically synthesized
gcaucaggugaaaauaga

SEQ ID NO: 12118 - RNA, 18 nt, artificial
  Chemically synthesized
caggucuaaagagagauu

SEQ ID NO: 12119 - RNA, 18 nt, artificial
  Chemically synthesized
gauugugagccacauuaa

SEQ ID NO: 12120 - RNA, 18 nt, artificial
  Chemically synthesized
gaagcaucaggugaaaau

SEQ ID NO: 12121 - RNA, 18 nt, artificial
  Chemically synthesized
gcucuggaugaagugcug

SEQ ID NO: 12122 - RNA, 18 nt, artificial
  Chemically synthesized
auugaagcucagaucuaa

SEQ ID NO: 12123 - RNA, 18 nt, artificial
  Chemically synthesized
cccaguccucauccuggc

SEQ ID NO: 12124 - RNA, 18 nt, artificial
  Chemically synthesized
caguccucauccuggcuu

SEQ ID NO: 12125 - RNA, 18 nt, artificial
  Chemically synthesized
caucaggugaaaauagaa

SEQ ID NO: 12126 - RNA, 18 nt, artificial
  Chemically synthesized
cuucugcaggacaaugaa

SEQ ID NO: 12127 - RNA, 18 nt, artificial
  Chemically synthesized
gaugauguuggcagcaau

SEQ ID NO: 12128 - RNA, 18 nt, artificial
  Chemically synthesized
ggucugagcaaucucaua

SEQ ID NO: 12129 - RNA, 18 nt, artificial
  Chemically synthesized
accagcggcucuggauga

SEQ ID NO: 12130 - RNA, 18 nt, artificial
  Chemically synthesized
gagucccagccaggcgcg

SEQ ID NO: 12131 - RNA, 18 nt, artificial
  Chemically synthesized
uggaugauguuggcagca

SEQ ID NO: 12132 - RNA, 18 nt, artificial
  Chemically synthesized
ccaguccucauccuggcu

SEQ ID NO: 12133 - RNA, 18 nt, artificial
  Chemically synthesized
ggguuuccugucaauauu

SEQ ID NO: 12134 - RNA, 18 nt, artificial
  Chemically synthesized
acugccaggucugagcaa

SEQ ID NO: 12135 - RNA, 18 nt, artificial
  Chemically synthesized
cauugaagcucagaucua

SEQ ID NO: 12136 - RNA, 18 nt, artificial
  Chemically synthesized
agaagcaucaggugaaaa

SEQ ID NO: 12137 - RNA, 18 nt, artificial
  Chemically synthesized
aggaaggccauggcuggg

SEQ ID NO: 12138 - RNA, 18 nt, artificial
  Chemically synthesized
gguaaguguuccugcuga

SEQ ID NO: 12139 - RNA, 18 nt, artificial
  Chemically synthesized
gauaacaaaggcaucaua

SEQ ID NO: 12140 - RNA, 18 nt, artificial
  Chemically synthesized
gaaggccauggcugggau

SEQ ID NO: 12141 - RNA, 18 nt, artificial
  Chemically synthesized
gugaaggcagagcugaaa

SEQ ID NO: 12142 - RNA, 18 nt, artificial
  Chemically synthesized
guccucauccuggcuuga

SEQ ID NO: 12143 - RNA, 18 nt, artificial
  Chemically synthesized
ggaaggccauggcuggga

SEQ ID NO: 12144 - RNA, 18 nt, Artificial Sequence
  Chemically synthesized
ccagcggcucuggaugaa

SEQ ID NO: 12145 - RNA, 19 nt, artificial
  Chemically synthesized
ccaugucccugaacaaaaa

SEQ ID NO: 12146 - RNA, 19 nt, artificial
  Chemically synthesized
ggcuguugcuggacuacau

SEQ ID NO: 12147 - RNA, 19 nt, artificial
  Chemically synthesized
ccaguauuuauaccucuaa

SEQ ID NO: 12148 - RNA, 19 nt, artificial
  Chemically synthesized
ggaccagcugagacuaaga

SEQ ID NO: 12149 - RNA, 19 nt, artificial
  Chemically synthesized
cuuccuauauccuggaaua

SEQ ID NO: 12150 - RNA, 19 nt, artificial
  Chemically synthesized
gacccaauguaccaguauu

SEQ ID NO: 12151 - RNA, 19 nt, artificial
  Chemically synthesized
ccuauauccuggaauauau

SEQ ID NO: 12152 - RNA, 19 nt, artificial
  Chemically synthesized
gcauauucaucaaguauga

SEQ ID NO: 12153 - RNA, 19 nt, artificial
  Chemically synthesized
ccucgagaccucaagggua

SEQ ID NO: 12154 - RNA, 19 nt, artificial
  Chemically synthesized
gacuuugaguacuuggaga

SEQ ID NO: 12155 - RNA, 19 nt, artificial
  Chemically synthesized
ggcaucuucuacauguuuu

SEQ ID NO: 12156 - RNA, 19 nt, artificial
  Chemically synthesized
cccuaaauccaauagaaaa

SEQ ID NO: 12157 - RNA, 19 nt, artificial
  Chemically synthesized
gaggcaucuucuacauguu

SEQ ID NO: 12158 - RNA, 19 nt, artificial
  Chemically synthesized
aguacaaggcaaugaagaa

SEQ ID NO: 12159 - RNA, 19 nt, artificial
  Chemically synthesized
ccuacucauugaaaccaaa

SEQ ID NO: 12160 - RNA, 19 nt, artificial
  Chemically synthesized
gcuccaccuggcaugagaa

SEQ ID NO: 12161 - RNA, 19 nt, artificial
  Chemically synthesized
accaguauuuauaccucua

SEQ ID NO: 12162 - RNA, 19 nt, artificial
  Chemically synthesized
cuggcauauucaucaagua

SEQ ID NO: 12163 - RNA, 19 nt, artificial
  Chemically synthesized
ccaauguaccaguauuuau

SEQ ID NO: 12164 - RNA, 19 nt, artificial
  Chemically synthesized
ggcgggugccgcaggagaa

SEQ ID NO: 12165 - RNA, 19 nt, artificial
  Chemically synthesized
ccuugagccuuauuuccua

SEQ ID NO: 12166 - RNA, 19 nt, artificial
  Chemically synthesized
gggagaacagagaguagcu

SEQ ID NO: 12167 - RNA, 19 nt, artificial
  Chemically synthesized
ccggcaacuggagacacaa

SEQ ID NO: 12168 - RNA, 19 nt, artificial
  Chemically synthesized
cuugcauccugaguuuaua

SEQ ID NO: 12169 - RNA, 19 nt, artificial
  Chemically synthesized
gccaaaaguauaucuugaa

SEQ ID NO: 12170 - RNA, 19 nt, artificial
  Chemically synthesized
ggcaacuggaacagacaaa

SEQ ID NO: 12171 - RNA, 19 nt, artificial
  Chemically synthesized
gggcggcgcuucucggaaa

SEQ ID NO: 12172 - RNA, 19 nt, artificial
  Chemically synthesized
ugcucuacuuaccucucaa

SEQ ID NO: 12173 - RNA, 19 nt, artificial
  Chemically synthesized
cucuaaugaagcacagaga

SEQ ID NO: 12174 - RNA, 19 nt, artificial
  Chemically synthesized
gugacuuccagaccaaauu

SEQ ID NO: 12175 - RNA, 19 nt, artificial
  Chemically synthesized
gcucuacuuaccucucaau

SEQ ID NO: 12176 - RNA, 19 nt, artificial
  Chemically synthesized
ccaucaaguacaaggcaau

SEQ ID NO: 12177 - RNA, 19 nt, artificial
  Chemically synthesized
ggcaccugugucuggucua

SEQ ID NO: 12178 - RNA, 19 nt, artificial
  Chemically synthesized
gaaugugacuuccagacca

SEQ ID NO: 12179 - RNA, 19 nt, artificial
  Chemically synthesized
ggaggcugagaagccuuua

SEQ ID NO: 12180 - RNA, 19 nt, artificial
  Chemically synthesized
gcuuaaacucacacaacaa

SEQ ID NO: 12181 - RNA, 19 nt, artificial
  Chemically synthesized
gcaguuuggcccagcccaa

SEQ ID NO: 12182 - RNA, 19 nt, artificial
  Chemically synthesized
ggcacucaucuauuccuuu

SEQ ID NO: 12183 - RNA, 19 nt, artificial
  Chemically synthesized
gggcacauacagacucaca

SEQ ID NO: 12184 - RNA, 19 nt, artificial
  Chemically synthesized
agauggacuuugaguacuu

SEQ ID NO: 12185 - RNA, 19 nt, artificial
  Chemically synthesized
ggaggauugccaaaaguau

SEQ ID NO: 12186 - RNA, 19 nt, artificial
  Chemically synthesized
cccuacucauugaaaccaa

SEQ ID NO: 12187 - RNA, 19 nt, artificial
  Chemically synthesized
ggcacauacagacucacau

SEQ ID NO: 12188 - RNA, 19 nt, artificial
  Chemically synthesized
ggaacagcuaggugggaaa

SEQ ID NO: 12189 - RNA, 19 nt, artificial
  Chemically synthesized
ccucuggcauauucaucaa

SEQ ID NO: 12190 - RNA, 19 nt, artificial
  Chemically synthesized
aggagauggacuuugagua

SEQ ID NO: 12191 - RNA, 19 nt, artificial
  Chemically synthesized
cagccaggacacuauagaa

SEQ ID NO: 12192 - RNA, 19 nt, artificial
  Chemically synthesized
gguucaucacugucugcga

SEQ ID NO: 12193 - RNA, 19 nt, artificial
  Chemically synthesized
ggcgcuucucggaaagcga

SEQ ID NO: 12194 - RNA, 19 nt, artificial
  Chemically synthesized
gccuaaccaugucccugaa

SEQ ID NO: 12195 - RNA, 19 nt, artificial
  Chemically synthesized
cugagacuaagaaggacca

SEQ ID NO: 12196 - RNA, 19 nt, artificial
  Chemically synthesized
cuugagccuuauuuccuaa

SEQ ID NO: 12197 - RNA, 19 nt, artificial
  Chemically synthesized
cccaucaaguacaaggcaa

SEQ ID NO: 12198 - RNA, 19 nt, artificial
  Chemically synthesized
gggcacucaucuauuccuu

SEQ ID NO: 12199 - RNA, 19 nt, artificial
  Chemically synthesized
aggcaaugaagaaagaguu

SEQ ID NO: 12200 - RNA, 19 nt, artificial
  Chemically synthesized
gcuggcuguugcuggacua

SEQ ID NO: 12201 - RNA, 19 nt, artificial
  Chemically synthesized
ggugguugucucugaugau

SEQ ID NO: 12202 - RNA, 19 nt, artificial
  Chemically synthesized
gcgcuucucggaaagcgaa

SEQ ID NO: 12203 - RNA, 19 nt, artificial
  Chemically synthesized
gccggaugguggugguugu

SEQ ID NO: 12204 - RNA, 19 nt, artificial
  Chemically synthesized
ggcuccagauuguagggca

SEQ ID NO: 12205 - RNA, 19 nt, artificial
  Chemically synthesized
cugagaaaagccgauauuu

SEQ ID NO: 12206 - RNA, 19 nt, artificial
  Chemically synthesized
guacagacauguacucuca

SEQ ID NO: 12207 - RNA, 19 nt, artificial
  Chemically synthesized
ggcggaggagauggacuuu

SEQ ID NO: 12208 - RNA, 19 nt, artificial
  Chemically synthesized
acccaauguaccaguauuu

SEQ ID NO: 12209 - RNA, 19 nt, artificial
  Chemically synthesized
agacuaagaaggaccagca

SEQ ID NO: 12210 - RNA, 19 nt, artificial
  Chemically synthesized
agagaguagcuguguuuga

SEQ ID NO: 12211 - RNA, 19 nt, artificial
  Chemically synthesized
gcaugaucuuguugaggca

SEQ ID NO: 12212 - RNA, 19 nt, artificial
  Chemically synthesized
ccuggagaugccaacuuca

SEQ ID NO: 12213 - RNA, 19 nt, artificial
  Chemically synthesized
cauguuuuguacgcauuaa

SEQ ID NO: 12214 - RNA, 19 nt, artificial
  Chemically synthesized
ggcauauucaucaaguaug

SEQ ID NO: 12215 - RNA, 19 nt, artificial
  Chemically synthesized
accaugucccugaacaaaa

SEQ ID NO: 12216 - RNA, 19 nt, artificial
  Chemically synthesized
gccaggacacuauagaaca

SEQ ID NO: 12217 - RNA, 19 nt, artificial
  Chemically synthesized
cucucaucugcaucuuuca

SEQ ID NO: 12218 - RNA, 19 nt, artificial
  Chemically synthesized
gccucuggcauauucauca

SEQ ID NO: 12219 - RNA, 19 nt, artificial
  Chemically synthesized
gcgacauccaguuugugca

SEQ ID NO: 12220 - RNA, 19 nt, artificial
  Chemically synthesized
cgcuucucggaaagcgaaa

SEQ ID NO: 12221 - RNA, 19 nt, artificial
  Chemically synthesized
ggaagcgcuggcagacaau

SEQ ID NO: 12222 - RNA, 19 nt, artificial
  Chemically synthesized
gcuggagcaagguaccuuu

SEQ ID NO: 12223 - RNA, 19 nt, artificial
  Chemically synthesized
cucgagaccucaaggguag

SEQ ID NO: 12224 - RNA, 19 nt, artificial
  Chemically synthesized
ccagagcaauuuauacuuu

SEQ ID NO: 12225 - RNA, 19 nt, artificial
  Chemically synthesized
ggagcugggacccagcauu

SEQ ID NO: 12226 - RNA, 19 nt, artificial
  Chemically synthesized
ggcauaugccugagcguuu

SEQ ID NO: 12227 - RNA, 19 nt, artificial
  Chemically synthesized
agcuggacaucacauuuca

SEQ ID NO: 12228 - RNA, 19 nt, artificial
  Chemically synthesized
ccagcgacauccaguuugu

SEQ ID NO: 12229 - RNA, 19 nt, artificial
  Chemically synthesized
ccagcugagacuaagaagg

SEQ ID NO: 12230 - RNA, 19 nt, artificial
  Chemically synthesized
cugagaagccuuuacaggu

SEQ ID NO: 12231 - RNA, 19 nt, artificial
  Chemically synthesized
gccgcaggagaaagaggaa

SEQ ID NO: 12232 - RNA, 19 nt, artificial
  Chemically synthesized
cucucugcaugaucuuguu

SEQ ID NO: 12233 - RNA, 19 nt, artificial
  Chemically synthesized
gggugccgcaggagaaaga

SEQ ID NO: 12234 - RNA, 19 nt, artificial
  Chemically synthesized
agacucacauacagacaca

SEQ ID NO: 12235 - RNA, 19 nt, artificial
  Chemically synthesized
acacauauauguacagaca

SEQ ID NO: 12236 - RNA, 19 nt, artificial
  Chemically synthesized
caaccuucagcagugacaa

SEQ ID NO: 12237 - RNA, 19 nt, artificial
  Chemically synthesized
acaucuucacccucaguuu

SEQ ID NO: 12238 - RNA, 19 nt, artificial
  Chemically synthesized
agacaaacuaucgacugaa

SEQ ID NO: 12239 - RNA, 19 nt, artificial
  Chemically synthesized
gggcacaugggcacauaca

SEQ ID NO: 12240 - RNA, 19 nt, artificial
  Chemically synthesized
agaguagcuguguuugaau

SEQ ID NO: 12241 - RNA, 19 nt, artificial
  Chemically synthesized
caggaccagcugagacuaa

SEQ ID NO: 12242 - RNA, 19 nt, artificial
  Chemically synthesized
cauacagacacacacauau

SEQ ID NO: 12243 - RNA, 19 nt, artificial
  Chemically synthesized
gcauaucuuugcuccacuu

SEQ ID NO: 12244 - RNA, 19 nt, artificial
  Chemically synthesized
cccucaguuuccucacuug

SEQ ID NO: 12245 - RNA, 19 nt, artificial
  Chemically synthesized
cuucccagagcaauuuaua

SEQ ID NO: 12246 - RNA, 19 nt, artificial
  Chemically synthesized
ggcugagaagccuuuacag

SEQ ID NO: 12247 - RNA, 19 nt, artificial
  Chemically synthesized
cacacaacaaugaacugca

SEQ ID NO: 12248 - RNA, 19 nt, artificial
  Chemically synthesized
ccucucaauuccuggagau

SEQ ID NO: 12249 - RNA, 19 nt, artificial
  Chemically synthesized
gcacucaucuauuccuuuu

SEQ ID NO: 12250 - RNA, 19 nt, artificial
  Chemically synthesized
gcugcuuaaacucacacaa

SEQ ID NO: 12251 - RNA, 19 nt, artificial
  Chemically synthesized
ggaggaaucugugcucuac

SEQ ID NO: 12252 - RNA, 19 nt, artificial
  Chemically synthesized
agccauucacacaucuuca

SEQ ID NO: 12253 - RNA, 19 nt, artificial
  Chemically synthesized
ugaucuuguugaggcauuu

SEQ ID NO: 12254 - RNA, 19 nt, artificial
  Chemically synthesized
agccuaaccaugucccuga

SEQ ID NO: 12255 - RNA, 19 nt, artificial
  Chemically synthesized
gcaccagcauacacacguu

SEQ ID NO: 12256 - RNA, 19 nt, artificial
  Chemically synthesized
caagaggcaucuucuacau

SEQ ID NO: 12257 - RNA, 19 nt, artificial
  Chemically synthesized
caguuugugcaggagauga

SEQ ID NO: 12258 - RNA, 19 nt, artificial
  Chemically synthesized
acacguuuuucuagguaca

SEQ ID NO: 12259 - RNA, 19 nt, artificial
  Chemically synthesized
ugccaaaaguauaucuuga

SEQ ID NO: 12260 - RNA, 19 nt, artificial
  Chemically synthesized
ggacccaauguaccaguau

SEQ ID NO: 12261 - RNA, 19 nt, artificial
  Chemically synthesized
aggcaucuucuacauguuu

SEQ ID NO: 12262 - RNA, 19 nt, artificial
  Chemically synthesized
gguacagcucccaggaaca

SEQ ID NO: 12263 - RNA, 19 nt, artificial
  Chemically synthesized
cugucugcgacuacaccaa

SEQ ID NO: 12264 - RNA, 19 nt, artificial
  Chemically synthesized
cccagagcaauuuauacuu

SEQ ID NO: 12265 - RNA, 19 nt, artificial
  Chemically synthesized
ccggcaacuggaacagaca

SEQ ID NO: 12266 - RNA, 19 nt, artificial
  Chemically synthesized
cucuugugucccuacucau

SEQ ID NO: 12267 - RNA, 19 nt, artificial
  Chemically synthesized
aaugugacuuccagaccaa

SEQ ID NO: 12268 - RNA, 19 nt, artificial
  Chemically synthesized
gcaucaccacacuugauga

SEQ ID NO: 12269 - RNA, 19 nt, artificial
  Chemically synthesized
cacauauauguacagacau

SEQ ID NO: 12270 - RNA, 19 nt, artificial
  Chemically synthesized
ugcucgagcugcuuaccaa

SEQ ID NO: 12271 - RNA, 19 nt, artificial
  Chemically synthesized
ggagaaggugccauggucu

SEQ ID NO: 12272 - RNA, 19 nt, artificial
  Chemically synthesized
cuggaaaggacccaaugua

SEQ ID NO: 12273 - RNA, 19 nt, artificial
  Chemically synthesized
gcauacacacguuuuucua

SEQ ID NO: 12274 - RNA, 19 nt, artificial
  Chemically synthesized
ccacagugaugccuacuga

SEQ ID NO: 12275 - RNA, 19 nt, artificial
  Chemically synthesized
accuugauugccuuacaaa

SEQ ID NO: 12276 - RNA, 19 nt, artificial
  Chemically synthesized
ccuucccagagcaauuuau

SEQ ID NO: 12277 - RNA, 19 nt, artificial
  Chemically synthesized
cggcaacuggaacagacaa

SEQ ID NO: 12278 - RNA, 19 nt, artificial
  Chemically synthesized
agcucagcucugagccauu

SEQ ID NO: 12279 - RNA, 19 nt, artificial
  Chemically synthesized
ccagcauccugagguucau

SEQ ID NO: 12280 - RNA, 19 nt, artificial
  Chemically synthesized
ccuuuaauacugggcauuu

SEQ ID NO: 12281 - RNA, 19 nt, artificial
  Chemically synthesized
acauacagacucacauaca

SEQ ID NO: 12282 - RNA, 19 nt, artificial
  Chemically synthesized
gugcucuacuuaccucuca

SEQ ID NO: 12283 - RNA, 19 nt, artificial
  Chemically synthesized
ccucaguuuccucacuuga

SEQ ID NO: 12284 - RNA, 19 nt, artificial
  Chemically synthesized
ugcuuaaacucacacaaca

SEQ ID NO: 12285 - RNA, 19 nt, artificial
  Chemically synthesized
aggaggaaucugugcucua

SEQ ID NO: 12286 - RNA, 19 nt, artificial
  Chemically synthesized
ggaaccaguggcugugagu

SEQ ID NO: 12287 - RNA, 19 nt, artificial
  Chemically synthesized
gccuuauuuccuaaugggu

SEQ ID NO: 12288 - RNA, 19 nt, artificial
  Chemically synthesized
aguauaucuugaagcagca

SEQ ID NO: 12289 - RNA, 19 nt, artificial
  Chemically synthesized
auguccacuugcuggauua

SEQ ID NO: 12290 - RNA, 19 nt, artificial
  Chemically synthesized
ggagcaagguaccuuuucu

SEQ ID NO: 12291 - RNA, 19 nt, artificial
  Chemically synthesized
ggcccugggugugugugua

SEQ ID NO: 12292 - RNA, 19 nt, artificial
  Chemically synthesized
agaggcaucuucuacaugu

SEQ ID NO: 12293 - RNA, 19 nt, artificial
  Chemically synthesized
ugguugucucugaugauua

SEQ ID NO: 12294 - RNA, 19 nt, artificial
  Chemically synthesized
cccuguaggaaauggugaa

SEQ ID NO: 12295 - RNA, 19 nt, artificial
  Chemically synthesized
acuggaacagacaaacuau

SEQ ID NO: 12296 - RNA, 19 nt, artificial
  Chemically synthesized
gggagagcuggcuguugcu

SEQ ID NO: 12297 - RNA, 19 nt, artificial
  Chemically synthesized
cuuccagaccaaauuugca

SEQ ID NO: 12298 - RNA, 19 nt, artificial
  Chemically synthesized
gguggugguugucucugau

SEQ ID NO: 12299 - RNA, 19 nt, artificial
  Chemically synthesized
aggaagcgcuggcagacaa

SEQ ID NO: 12300 - RNA, 19 nt, artificial
  Chemically synthesized
gaucuuguugaggcauuua

SEQ ID NO: 12301 - RNA, 19 nt, artificial
  Chemically synthesized
uccaguuugugcaggagau

SEQ ID NO: 12302 - RNA, 19 nt, artificial
  Chemically synthesized
ccagcauacacacguuuuu

SEQ ID NO: 12303 - RNA, 19 nt, artificial
  Chemically synthesized
ggucaugcucucagcucca

SEQ ID NO: 12304 - RNA, 19 nt, artificial
  Chemically synthesized
gggcaucaccacacuugau

SEQ ID NO: 12305 - RNA, 19 nt, artificial
  Chemically synthesized
agacauguacucucacaca

SEQ ID NO: 12306 - RNA, 19 nt, artificial
  Chemically synthesized
gugucccuacucauugaaa

SEQ ID NO: 12307 - RNA, 19 nt, artificial
  Chemically synthesized
agcuccaccuggcaugaga

SEQ ID NO: 12308 - RNA, 19 nt, artificial
  Chemically synthesized
aggacacuauagaacagga

SEQ ID NO: 12309 - RNA, 19 nt, artificial
  Chemically synthesized
gcaucuucuacauguuuug

SEQ ID NO: 12310 - RNA, 19 nt, artificial
  Chemically synthesized
gcgggugccgcaggagaaa

SEQ ID NO: 12311 - RNA, 19 nt, artificial
  Chemically synthesized
cagagagcuuucccaccaa

SEQ ID NO: 12312 - RNA, 19 nt, artificial
  Chemically synthesized
gcagcuggacaucacauuu

SEQ ID NO: 12313 - RNA, 19 nt, artificial
  Chemically synthesized
ggaggaggcugagaagccu

SEQ ID NO: 12314 - RNA, 19 nt, artificial
  Chemically synthesized
cucuacuuaccucucaauu

SEQ ID NO: 12315 - RNA, 19 nt, artificial
  Chemically synthesized
uccacuugcuggauuauca

SEQ ID NO: 12316 - RNA, 19 nt, artificial
  Chemically synthesized
ccuggaauauaucuugcau

SEQ ID NO: 12317 - RNA, 19 nt, artificial
  Chemically synthesized
gccucgagaccucaagggu

SEQ ID NO: 12318 - RNA, 19 nt, artificial
  Chemically synthesized
gaaucugugcucuacuuac

SEQ ID NO: 12319 - RNA, 19 nt, artificial
  Chemically synthesized
acuuugaguacuuggagau

SEQ ID NO: 12320 - RNA, 19 nt, artificial
  Chemically synthesized
ccaccaacuuuguaccuug

SEQ ID NO: 12321 - RNA, 19 nt, artificial
  Chemically synthesized
ggcagacaaugcgacccga

SEQ ID NO: 12322 - RNA, 19 nt, artificial
  Chemically synthesized
gcaaggaaugugacuucca

SEQ ID NO: 12323 - RNA, 19 nt, artificial
  Chemically synthesized
gcgacgacgugcugcugga

SEQ ID NO: 12324 - RNA, 19 nt, artificial
  Chemically synthesized
aggcugagaagccuuuaca

SEQ ID NO: 12325 - RNA, 19 nt, artificial
  Chemically synthesized
gcccaaccuucagcaguga

SEQ ID NO: 12326 - RNA, 19 nt, artificial
  Chemically synthesized
cuuuaauacugggcauuuu

SEQ ID NO: 12327 - RNA, 19 nt, artificial
  Chemically synthesized
cuguguuugaaucccugua

SEQ ID NO: 12328 - RNA, 19 nt, artificial
  Chemically synthesized
cugucugccuguccaugua

SEQ ID NO: 12329 - RNA, 19 nt, artificial
  Chemically synthesized
augugacuuccagaccaaa

SEQ ID NO: 12330 - RNA, 19 nt, artificial
  Chemically synthesized
caacaaugaacugcagaca

SEQ ID NO: 12331 - RNA, 19 nt, artificial
  Chemically synthesized
ggaacagacaaacuaucga

SEQ ID NO: 12332 - RNA, 19 nt, artificial
  Chemically synthesized
cagacacacacauauaugu

SEQ ID NO: 12333 - RNA, 19 nt, artificial
  Chemically synthesized
aacuggagacacaagcgga

SEQ ID NO: 12334 - RNA, 19 nt, artificial
  Chemically synthesized
ggguguguguguaucuguc

SEQ ID NO: 12335 - RNA, 19 nt, artificial
  Chemically synthesized
guacuuggagauccggcaa

SEQ ID NO: 12336 - RNA, 19 nt, artificial
  Chemically synthesized
ugugucuggucuauugcua

SEQ ID NO: 12337 - RNA, 19 nt, artificial
  Chemically synthesized
gucuauugcuagugagcuc

SEQ ID NO: 12338 - RNA, 19 nt, artificial
  Chemically synthesized
gagaacagagaguagcugu

SEQ ID NO: 12339 - RNA, 19 nt, artificial
  Chemically synthesized
ccucccagcuucugcccaa

SEQ ID NO: 12340 - RNA, 19 nt, artificial
  Chemically synthesized
cccaccuugagccuuauuu

SEQ ID NO: 12341 - RNA, 19 nt, artificial
  Chemically synthesized
gcauggaaccaguggcugu

SEQ ID NO: 12342 - RNA, 19 nt, artificial
  Chemically synthesized
ccaccuugagccuuauuuc

SEQ ID NO: 12343 - RNA, 19 nt, artificial
  Chemically synthesized
ggucuauugcuagugagcu

SEQ ID NO: 12344 - RNA, 19 nt, artificial
  Chemically synthesized
uggacuuugaguacuugga

SEQ ID NO: 12345 - RNA, 19 nt, artificial
  Chemically synthesized
cggcaacuggagacacaag

SEQ ID NO: 12346 - RNA, 19 nt, artificial
  Chemically synthesized
gaugagucacuguaaugau

SEQ ID NO: 12347 - RNA, 19 nt, artificial
  Chemically synthesized
agcugagacuaagaaggac

SEQ ID NO: 12348 - RNA, 19 nt, artificial
  Chemically synthesized
ggcaaugaagaaagaguuc

SEQ ID NO: 12349 - RNA, 19 nt, artificial
  Chemically synthesized
cuugcuggauuaucagcca

SEQ ID NO: 12350 - RNA, 19 nt, artificial
  Chemically synthesized
agagcuggcuguugcugga

SEQ ID NO: 12351 - RNA, 19 nt, artificial
  Chemically synthesized
cccagcauccugagguuca

SEQ ID NO: 12352 - RNA, 19 nt, artificial
  Chemically synthesized
ggcauguccacuugcugga

SEQ ID NO: 12353 - RNA, 19 nt, artificial
  Chemically synthesized
ugugacuuccagaccaaau

SEQ ID NO: 12354 - RNA, 19 nt, artificial
  Chemically synthesized
cccuuuaauacugggcauu

SEQ ID NO: 12355 - RNA, 19 nt, artificial
  Chemically synthesized
gcaggagaugauccggcaa

SEQ ID NO: 12356 - RNA, 19 nt, artificial
  Chemically synthesized
accugugucuggucuauug

SEQ ID NO: 12357 - RNA, 19 nt, artificial
  Chemically synthesized
uccuauauccuggaauaua

SEQ ID NO: 12358 - RNA, 19 nt, artificial
  Chemically synthesized
cacagugaugccuacugau

SEQ ID NO: 12359 - RNA, 19 nt, artificial
  Chemically synthesized
caccuggcaugagaaggga

SEQ ID NO: 12360 - RNA, 19 nt, artificial
  Chemically synthesized
ggauuaucagccaggacac

SEQ ID NO: 12361 - RNA, 19 nt, artificial
  Chemically synthesized
aguuugugcaggagaugau

SEQ ID NO: 12362 - RNA, 19 nt, artificial
  Chemically synthesized
uaucuugcauccugaguuu

SEQ ID NO: 12363 - RNA, 19 nt, artificial
  Chemically synthesized
acauguacucucacacaca

SEQ ID NO: 12364 - RNA, 19 nt, artificial
  Chemically synthesized
agccgauauuugccauucu

SEQ ID NO: 12365 - RNA, 19 nt, artificial
  Chemically synthesized
auaccucuaaugaagcaca

SEQ ID NO: 12366 - RNA, 19 nt, artificial
  Chemically synthesized
gugugugucugaccgcgau

SEQ ID NO: 12367 - RNA, 19 nt, artificial
  Chemically synthesized
ccaaccuucagcagugaca

SEQ ID NO: 12368 - RNA, 19 nt, artificial
  Chemically synthesized
gaggaggcugagaagccuu

SEQ ID NO: 12369 - RNA, 19 nt, artificial
  Chemically synthesized
gcaucuuucacaccuccca

SEQ ID NO: 12370 - RNA, 19 nt, artificial
  Chemically synthesized
gcucugagccauucacaca

SEQ ID NO: 12371 - RNA, 19 nt, artificial
  Chemically synthesized
uccggcaacuggagacaca

SEQ ID NO: 12372 - RNA, 19 nt, artificial
  Chemically synthesized
gaugccuacugaugcuuca

SEQ ID NO: 12373 - RNA, 19 nt, artificial
  Chemically synthesized
cacauacagacacacacau

SEQ ID NO: 12374 - RNA, 19 nt, artificial
  Chemically synthesized
cuaaugaagcacagagaga

SEQ ID NO: 12375 - RNA, 19 nt, artificial
  Chemically synthesized
agacacacacauauaugua

SEQ ID NO: 12376 - RNA, 19 nt, artificial
  Chemically synthesized
gguccaccucucaucugca

SEQ ID NO: 12377 - RNA, 19 nt, artificial
  Chemically synthesized
ggcugcucucaacaugcga

SEQ ID NO: 12378 - RNA, 19 nt, artificial
  Chemically synthesized
cagaccaaauuugcacuca

SEQ ID NO: 12379 - RNA, 19 nt, artificial
  Chemically synthesized
agcaggaggaggcugagaa

SEQ ID NO: 12380 - RNA, 19 nt, artificial
  Chemically synthesized
caaagauaucugagaaaag

SEQ ID NO: 12381 - RNA, 19 nt, artificial
  Chemically synthesized
cuaaccaugucccugaaca

SEQ ID NO: 12382 - RNA, 19 nt, artificial
  Chemically synthesized
acagagaguagcuguguuu

SEQ ID NO: 12383 - RNA, 19 nt, artificial
  Chemically synthesized
ugcuagugagcucaucgaa

SEQ ID NO: 12384 - RNA, 19 nt, artificial
  Chemically synthesized
ggcuggagcaagguaccuu

SEQ ID NO: 12385 - RNA, 19 nt, artificial
  Chemically synthesized
agaugauccggcaacugga

SEQ ID NO: 12386 - RNA, 19 nt, artificial
  Chemically synthesized
gauaucugagaaaagccga

SEQ ID NO: 12387 - RNA, 19 nt, artificial
  Chemically synthesized
cacauuucauguccugcau

SEQ ID NO: 12388 - RNA, 19 nt, artificial
  Chemically synthesized
accuggcaugagaagggau

SEQ ID NO: 12389 - RNA, 19 nt, artificial
  Chemically synthesized
aguacuuggagauccggca

SEQ ID NO: 12390 - RNA, 19 nt, artificial
  Chemically synthesized
gugaguggcauguccacuu

SEQ ID NO: 12391 - RNA, 19 nt, artificial
  Chemically synthesized
gcugagacuaagaaggacc

SEQ ID NO: 12392 - RNA, 19 nt, artificial
  Chemically synthesized
ggcauuuagcugccaugca

SEQ ID NO: 12393 - RNA, 19 nt, artificial
  Chemically synthesized
agagcugcuuaaacucaca

SEQ ID NO: 12394 - RNA, 19 nt, artificial
  Chemically synthesized
uugcauccugaguuuauaa

SEQ ID NO: 12395 - RNA, 19 nt, artificial
  Chemically synthesized
uggcauauucaucaaguau

SEQ ID NO: 12396 - RNA, 19 nt, artificial
  Chemically synthesized
agaccucaaggguagaggu

SEQ ID NO: 12397 - RNA, 19 nt, artificial
  Chemically synthesized
gaggaaucugugcucuacu

SEQ ID NO: 12398 - RNA, 19 nt, artificial
  Chemically synthesized
gccacugcugugaccacga

SEQ ID NO: 12399 - RNA, 19 nt, artificial
  Chemically synthesized
ucuugaacgugcggacaca

SEQ ID NO: 12400 - RNA, 19 nt, artificial
  Chemically synthesized
cgggcaucaccacacuuga

SEQ ID NO: 12401 - RNA, 19 nt, artificial
  Chemically synthesized
uggagauccggcaacugga

SEQ ID NO: 12402 - RNA, 19 nt, artificial
  Chemically synthesized
caggcuuggcugcgggaga

SEQ ID NO: 12403 - RNA, 19 nt, artificial
  Chemically synthesized
aaaauugggcacucaucua

SEQ ID NO: 12404 - RNA, 19 nt, artificial
  Chemically synthesized
cguuuuucuagguacagcu

SEQ ID NO: 12405 - RNA, 19 nt, artificial
  Chemically synthesized
aggauugccaaaaguauau

SEQ ID NO: 12406 - RNA, 19 nt, artificial
  Chemically synthesized
uaaccaugucccugaacaa

SEQ ID NO: 12407 - RNA, 19 nt, artificial
  Chemically synthesized
augggcacauacagacuca

SEQ ID NO: 12408 - RNA, 19 nt, artificial
  Chemically synthesized
gggaaagucccaucacuga

SEQ ID NO: 12409 - RNA, 19 nt, artificial
  Chemically synthesized
cauauauguacagacaugu

SEQ ID NO: 12410 - RNA, 19 nt, artificial
  Chemically synthesized
ucacauacagacacacaca

SEQ ID NO: 12411 - RNA, 19 nt, artificial
  Chemically synthesized
gcuggacaucacauuucau

SEQ ID NO: 12412 - RNA, 19 nt, artificial
  Chemically synthesized
ccuugauugccuuacaaag

SEQ ID NO: 12413 - RNA, 19 nt, artificial
  Chemically synthesized
acagacauguacucucaca

SEQ ID NO: 12414 - RNA, 19 nt, artificial
  Chemically synthesized
gacccagcauugaggagga

SEQ ID NO: 12415 - RNA, 19 nt, artificial
  Chemically synthesized
agaccaaauuugcacucag

SEQ ID NO: 12416 - RNA, 19 nt, artificial
  Chemically synthesized
acaggaccagcugagacua

SEQ ID NO: 12417 - RNA, 19 nt, artificial
  Chemically synthesized
caucuauuccuuuucucuu

SEQ ID NO: 12418 - RNA, 19 nt, artificial
  Chemically synthesized
aggacccaauguaccagua

SEQ ID NO: 12419 - RNA, 19 nt, artificial
  Chemically synthesized
auacagacucacauacaga

SEQ ID NO: 12420 - RNA, 19 nt, artificial
  Chemically synthesized
ccgcgcuggcggaggagau

SEQ ID NO: 12421 - RNA, 19 nt, artificial
  Chemically synthesized
uguccugcauggaaccagu

SEQ ID NO: 12422 - RNA, 19 nt, artificial
  Chemically synthesized
aggaggauugccaaaagua

SEQ ID NO: 12423 - RNA, 19 nt, artificial
  Chemically synthesized
gaugauuaccugcagagca

SEQ ID NO: 12424 - RNA, 19 nt, artificial
  Chemically synthesized
caguuuccucacuugagga

SEQ ID NO: 12425 - RNA, 19 nt, artificial
  Chemically synthesized
cugugucuggucuauugcu

SEQ ID NO: 12426 - RNA, 19 nt, artificial
  Chemically synthesized
aggaggcugagaagccuuu

SEQ ID NO: 12427 - RNA, 19 nt, artificial
  Chemically synthesized
ggaugguggugguugucuc

SEQ ID NO: 12428 - RNA, 19 nt, artificial
  Chemically synthesized
aaggcaaugaagaaagagu

SEQ ID NO: 12429 - RNA, 19 nt, artificial
  Chemically synthesized
gggaugagucacuguaaug

SEQ ID NO: 12430 - RNA, 19 nt, artificial
  Chemically synthesized
caucacugagggagccuaa

SEQ ID NO: 12431 - RNA, 19 nt, artificial
  Chemically synthesized
ugguggugguugucucuga

SEQ ID NO: 12432 - RNA, 19 nt, artificial
  Chemically synthesized
aucugagaaaagccgauau

SEQ ID NO: 12433 - RNA, 19 nt, artificial
  Chemically synthesized
ccaaauuugcacucagccu

SEQ ID NO: 12434 - RNA, 19 nt, artificial
  Chemically synthesized
cccuggcugcucucaacau

SEQ ID NO: 12435 - RNA, 19 nt, artificial
  Chemically synthesized
guuugaaucccuguaggaa

SEQ ID NO: 12436 - RNA, 19 nt, artificial
  Chemically synthesized
acauguuuuguacgcauua

SEQ ID NO: 12437 - RNA, 19 nt, artificial
  Chemically synthesized
acccuaaauccaauagaaa

SEQ ID NO: 12438 - RNA, 19 nt, artificial
  Chemically synthesized
cauugaggaggauugccaa

SEQ ID NO: 12439 - RNA, 19 nt, artificial
  Chemically synthesized
cucucuccuucccagagca

SEQ ID NO: 12440 - RNA, 19 nt, artificial
  Chemically synthesized
gagaaggugccauggucuu

SEQ ID NO: 12441 - RNA, 19 nt, artificial
  Chemically synthesized
ccagcuucugcccaaccuu

SEQ ID NO: 12442 - RNA, 19 nt, artificial
  Chemically synthesized
gacuuccagaccaaauuug

SEQ ID NO: 12443 - RNA, 19 nt, artificial
  Chemically synthesized
cuuuguaccuugauugccu

SEQ ID NO: 12444 - RNA, 19 nt, artificial
  Chemically synthesized
gccuuacaaaguuauuugu

SEQ ID NO: 12445 - RNA, 19 nt, artificial
  Chemically synthesized
acauauauguacagacaug

SEQ ID NO: 12446 - RNA, 19 nt, artificial
  Chemically synthesized
gacagacccuaggacccua

SEQ ID NO: 12447 - RNA, 19 nt, artificial
  Chemically synthesized
agcaguuuggcccagccca

SEQ ID NO: 12448 - RNA, 19 nt, artificial
  Chemically synthesized
gaagcauagcucugggucu

SEQ ID NO: 12449 - RNA, 19 nt, artificial
  Chemically synthesized
ucuccuucccagagcaauu

SEQ ID NO: 12450 - RNA, 19 nt, artificial
  Chemically synthesized
gcccugaagacuguucuga

SEQ ID NO: 12451 - RNA, 19 nt, artificial
  Chemically synthesized
accucucaauuccuggaga

SEQ ID NO: 12452 - RNA, 19 nt, artificial
  Chemically synthesized
gcccuggguguguguguau

SEQ ID NO: 12453 - RNA, 19 nt, artificial
  Chemically synthesized
cccaaagcuugugggcaca

SEQ ID NO: 12454 - RNA, 19 nt, artificial
  Chemically synthesized
cgacugaaguugugugugu

SEQ ID NO: 12455 - RNA, 19 nt, artificial
  Chemically synthesized
uggugguugucucugauga

SEQ ID NO: 12456 - RNA, 19 nt, artificial
  Chemically synthesized
uugugucccuacucauuga

SEQ ID NO: 12457 - RNA, 19 nt, artificial
  Chemically synthesized
cagcuucuuccacagugau

SEQ ID NO: 12458 - RNA, 19 nt, artificial
  Chemically synthesized
cucugcaugaucuuguuga

SEQ ID NO: 12459 - RNA, 19 nt, artificial
  Chemically synthesized
aauauaucuugcauccuga

SEQ ID NO: 12460 - RNA, 19 nt, artificial
  Chemically synthesized
ugcagagcaaggaauguga

SEQ ID NO: 12461 - RNA, 19 nt, artificial
  Chemically synthesized
gcugugaguggcaugucca

SEQ ID NO: 12462 - RNA, 19 nt, artificial
  Chemically synthesized
gggcugcuuuucauuucca

SEQ ID NO: 12463 - RNA, 19 nt, artificial
  Chemically synthesized
gccaggcuggagcaaggua

SEQ ID NO: 12464 - RNA, 19 nt, artificial
  Chemically synthesized
gggcauaugccugagcguu

SEQ ID NO: 12465 - RNA, 19 nt, artificial
  Chemically synthesized
agaaggaccagcagagcca

SEQ ID NO: 12466 - RNA, 19 nt, artificial
  Chemically synthesized
cguuguaggaggaaucugu

SEQ ID NO: 12467 - RNA, 19 nt, artificial
  Chemically synthesized
gcccauuccacuuccuccu

SEQ ID NO: 12468 - RNA, 19 nt, artificial
  Chemically synthesized
ucuugugucccuacucauu

SEQ ID NO: 12469 - RNA, 19 nt, artificial
  Chemically synthesized
ugagaaaagccgauauuug

SEQ ID NO: 12470 - RNA, 19 nt, artificial
  Chemically synthesized
ccuggguguguguguaucu

SEQ ID NO: 12471 - RNA, 19 nt, artificial
  Chemically synthesized
ucucaagaggcaucuucua

SEQ ID NO: 12472 - RNA, 19 nt, artificial
  Chemically synthesized
gcgcuggcagacaaugcga

SEQ ID NO: 12473 - RNA, 19 nt, artificial
  Chemically synthesized
ucgagaccucaaggguaga

SEQ ID NO: 12474 - RNA, 19 nt, artificial
  Chemically synthesized
gcccaucagaagcgacuga

SEQ ID NO: 12475 - RNA, 19 nt, artificial
  Chemically synthesized
gaugccuucaucugcuauu

SEQ ID NO: 12476 - RNA, 19 nt, artificial
  Chemically synthesized
ccaacuucacagacacguc

SEQ ID NO: 12477 - RNA, 19 nt, artificial
  Chemically synthesized
agagcaaggaaugugacuu

SEQ ID NO: 12478 - RNA, 19 nt, artificial
  Chemically synthesized
cuugauugccuuacaaagu

SEQ ID NO: 12479 - RNA, 19 nt, artificial
  Chemically synthesized
accaaaucuugguucugga

SEQ ID NO: 12480 - RNA, 19 nt, artificial
  Chemically synthesized
cacccucaguuuccucacu

SEQ ID NO: 12481 - RNA, 19 nt, artificial
  Chemically synthesized
ccaguggcugugaguggca

SEQ ID NO: 12482 - RNA, 19 nt, artificial
  Chemically synthesized
gcagagagcuuucccacca

SEQ ID NO: 12483 - RNA, 19 nt, artificial
  Chemically synthesized
uggcggaggagauggacuu

SEQ ID NO: 12484 - RNA, 19 nt, artificial
  Chemically synthesized
gcagcagcuggacaucaca

SEQ ID NO: 12485 - RNA, 19 nt, artificial
  Chemically synthesized
cacagacacgucugcagca

SEQ ID NO: 12486 - RNA, 19 nt, artificial
  Chemically synthesized
cugugcucuacuuaccucu

SEQ ID NO: 12487 - RNA, 19 nt, artificial
  Chemically synthesized
caauuccuggagaugccaa

SEQ ID NO: 12488 - RNA, 19 nt, artificial
  Chemically synthesized
cagcagugucccacggaca

SEQ ID NO: 12489 - RNA, 19 nt, artificial
  Chemically synthesized
gagccuuauuuccuaaugg

SEQ ID NO: 12490 - RNA, 19 nt, artificial
  Chemically synthesized
auauguacagacauguacu

SEQ ID NO: 12491 - RNA, 19 nt, artificial
  Chemically synthesized
aggagaaagaggaagcgcu

SEQ ID NO: 12492 - RNA, 19 nt, artificial
  Chemically synthesized
gagaaaagccgauauuugc

SEQ ID NO: 12493 - RNA, 19 nt, artificial
  Chemically synthesized
gccuguggucaugcucuca

SEQ ID NO: 12494 - RNA, 19 nt, artificial
  Chemically synthesized
aucuugcauccugaguuua

SEQ ID NO: 12495 - RNA, 19 nt, artificial
  Chemically synthesized
gccaccugcagagagcuuu

SEQ ID NO: 12496 - RNA, 19 nt, artificial
  Chemically synthesized
auaucuugcauccugaguu

SEQ ID NO: 12497 - RNA, 19 nt, artificial
  Chemically synthesized
ugaaguugugugugucuga

SEQ ID NO: 12498 - RNA, 19 nt, artificial
  Chemically synthesized
guucuugaacgugcggaca

SEQ ID NO: 12499 - RNA, 19 nt, artificial
  Chemically synthesized
gcuucagugccucugcaca

SEQ ID NO: 12500 - RNA, 19 nt, artificial
  Chemically synthesized
cuacauguuuuguacgcau

SEQ ID NO: 12501 - RNA, 19 nt, artificial
  Chemically synthesized
ggcgccgccugucucuguu

SEQ ID NO: 12502 - RNA, 19 nt, artificial
  Chemically synthesized
aggagaugauccggcaacu

SEQ ID NO: 12503 - RNA, 19 nt, artificial
  Chemically synthesized
guaucugucugccugucca

SEQ ID NO: 12504 - RNA, 19 nt, artificial
  Chemically synthesized
caguggcugugaguggcau

SEQ ID NO: 12505 - RNA, 19 nt, artificial
  Chemically synthesized
gcuugugggcacaugggca

SEQ ID NO: 12506 - RNA, 19 nt, artificial
  Chemically synthesized
accucuaaugaagcacaga

SEQ ID NO: 12507 - RNA, 19 nt, artificial
  Chemically synthesized
gugccauggucuuaggugu

SEQ ID NO: 12508 - RNA, 19 nt, artificial
  Chemically synthesized
cuccuucccagagcaauuu

SEQ ID NO: 12509 - RNA, 19 nt, artificial
  Chemically synthesized
cauuuuaaagccaucucaa

SEQ ID NO: 12510 - RNA, 19 nt, artificial
  Chemically synthesized
ggacuuugaguacuuggag

SEQ ID NO: 12511 - RNA, 19 nt, artificial
  Chemically synthesized
gguguguguguaucugucu

SEQ ID NO: 12512 - RNA, 19 nt, artificial
  Chemically synthesized
agaacaggaccagcugaga

SEQ ID NO: 12513 - RNA, 19 nt, artificial
  Chemically synthesized
aacagagaguagcuguguu

SEQ ID NO: 12514 - RNA, 19 nt, artificial
  Chemically synthesized
ggccgcuguagacagcagu

SEQ ID NO: 12515 - RNA, 19 nt, artificial
  Chemically synthesized
gaggagauggacuuugagu

SEQ ID NO: 12516 - RNA, 19 nt, artificial
  Chemically synthesized
gagucacuguaaugaugug

SEQ ID NO: 12517 - RNA, 19 nt, artificial
  Chemically synthesized
ggcacaugggcacauacag

SEQ ID NO: 12518 - RNA, 19 nt, artificial
  Chemically synthesized
aauugggcacucaucuauu

SEQ ID NO: 12519 - RNA, 19 nt, artificial
  Chemically synthesized
cgcuggcggaggagaugga

SEQ ID NO: 12520 - RNA, 19 nt, artificial
  Chemically synthesized
cuggucuauugcuagugag

SEQ ID NO: 12521 - RNA, 19 nt, artificial
  Chemically synthesized
cugcagacacagcuguucu

SEQ ID NO: 12522 - RNA, 19 nt, artificial
  Chemically synthesized
cacauacagacucacauac

SEQ ID NO: 12523 - RNA, 19 nt, artificial
  Chemically synthesized
cuuaaacucacacaacaau

SEQ ID NO: 12524 - RNA, 19 nt, artificial
  Chemically synthesized
ggcgggcaucaccacacuu

SEQ ID NO: 12525 - RNA, 19 nt, artificial
  Chemically synthesized
gccuugucccugcccugaa

SEQ ID NO: 12526 - RNA, 19 nt, artificial
  Chemically synthesized
ucuugcauccugaguuuau

SEQ ID NO: 12527 - RNA, 19 nt, artificial
  Chemically synthesized
gauccggcaacuggagaca

SEQ ID NO: 12528 - RNA, 19 nt, artificial
  Chemically synthesized
gugucuggucuauugcuag

SEQ ID NO: 12529 - RNA, 19 nt, artificial
  Chemically synthesized
cgcuguagacagcaguguc

SEQ ID NO: 12530 - RNA, 19 nt, artificial
  Chemically synthesized
auuugccauucuuccuaua

SEQ ID NO: 12531 - RNA, 19 nt, artificial
  Chemically synthesized
caugucccugaacaaaaau

SEQ ID NO: 12532 - RNA, 19 nt, artificial
  Chemically synthesized
ugagaagccuuuacaggug

SEQ ID NO: 12533 - RNA, 19 nt, artificial
  Chemically synthesized
augaucuuguugaggcauu

SEQ ID NO: 12534 - RNA, 19 nt, artificial
  Chemically synthesized
gagcguuucgaugccuuca

SEQ ID NO: 12535 - RNA, 19 nt, artificial
  Chemically synthesized
gacaaacuaucgacugaag

SEQ ID NO: 12536 - RNA, 19 nt, artificial
  Chemically synthesized
gcauuuuaaagccaucuca

SEQ ID NO: 12537 - RNA, 19 nt, artificial
  Chemically synthesized
aaccaugucccugaacaaa

SEQ ID NO: 12538 - RNA, 19 nt, artificial
  Chemically synthesized
ggcugugaguggcaugucc

SEQ ID NO: 12539 - RNA, 19 nt, artificial
  Chemically synthesized
ggcagcuucuuccacagug

SEQ ID NO: 12540 - RNA, 19 nt, artificial
  Chemically synthesized
uaccaguauuuauaccucu

SEQ ID NO: 12541 - RNA, 19 nt, artificial
  Chemically synthesized
uaccuugauugccuuacaa

SEQ ID NO: 12542 - RNA, 19 nt, artificial
  Chemically synthesized
uggagaugccaacuucaca

SEQ ID NO: 12543 - RNA, 19 nt, artificial
  Chemically synthesized
ggcaugagaagggauccug

SEQ ID NO: 12544 - RNA, 19 nt, artificial
  Chemically synthesized
uguagacagcaguguccca

SEQ ID NO: 12545 - RNA, 19 nt, artificial
  Chemically synthesized
cccugaagacuguucugag

SEQ ID NO: 12546 - RNA, 19 nt, artificial
  Chemically synthesized
agcuucugcccaaccuuca

SEQ ID NO: 12547 - RNA, 19 nt, artificial
  Chemically synthesized
cuauugcuagugagcucau

SEQ ID NO: 12548 - RNA, 19 nt, artificial
  Chemically synthesized
gggagaccaggcuuggcug

SEQ ID NO: 12549 - RNA, 19 nt, artificial
  Chemically synthesized
acacacacauauauguaca

SEQ ID NO: 12550 - RNA, 19 nt, artificial
  Chemically synthesized
ggagccuaaccaugucccu

SEQ ID NO: 12551 - RNA, 19 nt, artificial
  Chemically synthesized
ucugagaaaagccgauauu

SEQ ID NO: 12552 - RNA, 19 nt, artificial
  Chemically synthesized
ccuggcaugagaagggauc

SEQ ID NO: 12553 - RNA, 19 nt, artificial
  Chemically synthesized
gaccagcagagccagcuca

SEQ ID NO: 12554 - RNA, 19 nt, artificial
  Chemically synthesized
gugggaaagucccaucacu

SEQ ID NO: 12555 - RNA, 19 nt, artificial
  Chemically synthesized
gaccaaauuugcacucagc

SEQ ID NO: 12556 - RNA, 19 nt, artificial
  Chemically synthesized
ucaagaggcaucuucuaca

SEQ ID NO: 12557 - RNA, 19 nt, artificial
  Chemically synthesized
ggaauauaucuugcauccu

SEQ ID NO: 12558 - RNA, 19 nt, artificial
  Chemically synthesized
ccaucacugagggagccua

SEQ ID NO: 12559 - RNA, 19 nt, artificial
  Chemically synthesized
uacagacacacacauauau

SEQ ID NO: 12560 - RNA, 19 nt, artificial
  Chemically synthesized
ggagaaagaggaagcgcug

SEQ ID NO: 12561 - RNA, 19 nt, artificial
  Chemically synthesized
ugcauccugaguuuauaau

SEQ ID NO: 12562 - RNA, 19 nt, artificial
  Chemically synthesized
ccuuauuuccuaauggguc

SEQ ID NO: 12563 - RNA, 19 nt, artificial
  Chemically synthesized
gagacucgccugagcagcu

SEQ ID NO: 12564 - RNA, 19 nt, artificial
  Chemically synthesized
cucaucugcaucuuucaca

SEQ ID NO: 12565 - RNA, 19 nt, artificial
  Chemically synthesized
ccugaacaaaaauugggca

SEQ ID NO: 12566 - RNA, 19 nt, artificial
  Chemically synthesized
caaugaacugcagacacag

SEQ ID NO: 12567 - RNA, 19 nt, artificial
  Chemically synthesized
ucucuugugucccuacuca

SEQ ID NO: 12568 - RNA, 19 nt, artificial
  Chemically synthesized
cuuucacaccucccagcuu

SEQ ID NO: 12569 - RNA, 19 nt, artificial
  Chemically synthesized
gggcagcuucuuccacagu

SEQ ID NO: 12570 - RNA, 19 nt, artificial
  Chemically synthesized
cucauugaaaccaaacucu

SEQ ID NO: 12571 - RNA, 19 nt, artificial
  Chemically synthesized
gcaauuuauacuuuacccu

SEQ ID NO: 12572 - RNA, 19 nt, artificial
  Chemically synthesized
ugucuggucuauugcuagu

SEQ ID NO: 12573 - RNA, 19 nt, artificial
  Chemically synthesized
acucacauacagacacaca

SEQ ID NO: 12574 - RNA, 19 nt, artificial
  Chemically synthesized
accucucaucugcaucuuu

SEQ ID NO: 12575 - RNA, 19 nt, artificial
  Chemically synthesized
gccuguccauguacuucug

SEQ ID NO: 12576 - RNA, 19 nt, artificial
  Chemically synthesized
accagcugagacuaagaag

SEQ ID NO: 12577 - RNA, 19 nt, artificial
  Chemically synthesized
gccucugcacaccgcccau

SEQ ID NO: 12578 - RNA, 19 nt, artificial
  Chemically synthesized
uggauuaucagccaggaca

SEQ ID NO: 12579 - RNA, 19 nt, artificial
  Chemically synthesized
agccuuauuuccuaauggg

SEQ ID NO: 12580 - RNA, 19 nt, artificial
  Chemically synthesized
gaauauaucuugcauccug

SEQ ID NO: 12581 - RNA, 19 nt, artificial
  Chemically synthesized
gaacugcagacacagcugu

SEQ ID NO: 12582 - RNA, 19 nt, artificial
  Chemically synthesized
aggaagagagcugcuuaaa

SEQ ID NO: 12583 - RNA, 19 nt, artificial
  Chemically synthesized
gccuccuccuuucguugua

SEQ ID NO: 12584 - RNA, 19 nt, artificial
  Chemically synthesized
gaggcugagaagccuuuac

SEQ ID NO: 12585 - RNA, 19 nt, artificial
  Chemically synthesized
gccauucuuccuauauccu

SEQ ID NO: 12586 - RNA, 19 nt, artificial
  Chemically synthesized
auaucugagaaaagccgau

SEQ ID NO: 12587 - RNA, 19 nt, artificial
  Chemically synthesized
gcuugggcugcuuuucauu

SEQ ID NO: 12588 - RNA, 19 nt, artificial
  Chemically synthesized
guaccaguauuuauaccuc

SEQ ID NO: 12589 - RNA, 19 nt, artificial
  Chemically synthesized
cucuguucuugaacgugcg

SEQ ID NO: 12590 - RNA, 19 nt, artificial
  Chemically synthesized
augucccugaacaaaaauu

SEQ ID NO: 12591 - RNA, 19 nt, artificial
  Chemically synthesized
acacuauagaacaggacca

SEQ ID NO: 12592 - RNA, 19 nt, artificial
  Chemically synthesized
agcagcuggacaucacauu

SEQ ID NO: 12593 - RNA, 19 nt, artificial
  Chemically synthesized
ggagauccggcaacuggag

SEQ ID NO: 12594 - RNA, 19 nt, artificial
  Chemically synthesized
cauguccacuugcuggauu

SEQ ID NO: 12595 - RNA, 19 nt, artificial
  Chemically synthesized
ccucuaaugaagcacagag

SEQ ID NO: 12596 - RNA, 19 nt, artificial
  Chemically synthesized
ccaaaaguauaucuugaag

SEQ ID NO: 12597 - RNA, 19 nt, artificial
  Chemically synthesized
agcaagguaccuuuucuua

SEQ ID NO: 12598 - RNA, 19 nt, artificial
  Chemically synthesized
gccuacugaugcuucagug

SEQ ID NO: 12599 - RNA, 19 nt, artificial
  Chemically synthesized
cugucucuguucuugaacg

SEQ ID NO: 12600 - RNA, 19 nt, artificial
  Chemically synthesized
cuuauuuccuaaugggucc

SEQ ID NO: 12601 - RNA, 19 nt, artificial
  Chemically synthesized
cucaguuuccucacuugag

SEQ ID NO: 12602 - RNA, 19 nt, artificial
  Chemically synthesized
cucugagccauucacacau

SEQ ID NO: 12603 - RNA, 19 nt, artificial
  Chemically synthesized
ugcaccaaaucuugguucu

SEQ ID NO: 12604 - RNA, 19 nt, artificial
  Chemically synthesized
gcuguguuugaaucccugu

SEQ ID NO: 12605 - RNA, 19 nt, artificial
  Chemically synthesized
cagcucugagccauucaca

SEQ ID NO: 12606 - RNA, 19 nt, artificial
  Chemically synthesized
cccauuccacuuccuccuu

SEQ ID NO: 12607 - RNA, 19 nt, artificial
  Chemically synthesized
agcuggcuguugcuggacu

SEQ ID NO: 12608 - RNA, 19 nt, artificial
  Chemically synthesized
ggaugccuguggucaugcu

SEQ ID NO: 12609 - RNA, 19 nt, artificial
  Chemically synthesized
caacuucacagacacgucu

SEQ ID NO: 12610 - RNA, 19 nt, artificial
  Chemically synthesized
gcaugagaagggauccugg

SEQ ID NO: 12611 - RNA, 19 nt, artificial
  Chemically synthesized
ggagaugccaacuucacag

SEQ ID NO: 12612 - RNA, 19 nt, artificial
  Chemically synthesized
ggcaacuggagacacaagc

SEQ ID NO: 12613 - RNA, 19 nt, artificial
  Chemically synthesized
ccaucagaagcgacugauc

SEQ ID NO: 12614 - RNA, 19 nt, artificial
  Chemically synthesized
uuugaaucccuguaggaaa

SEQ ID NO: 12615 - RNA, 19 nt, artificial
  Chemically synthesized
cagcucagcucugagccau

SEQ ID NO: 12616 - RNA, 19 nt, artificial
  Chemically synthesized
gcaggaggaggcugagaag

SEQ ID NO: 12617 - RNA, 19 nt, artificial
  Chemically synthesized
ggagaacagagaguagcug

SEQ ID NO: 12618 - RNA, 19 nt, artificial
  Chemically synthesized
auuuguuuacaaacagcga

SEQ ID NO: 12619 - RNA, 19 nt, artificial
  Chemically synthesized
cacugagggagccuaacca

SEQ ID NO: 12620 - RNA, 19 nt, artificial
  Chemically synthesized
aacuggaacagacaaacua

SEQ ID NO: 12621 - RNA, 19 nt, artificial
  Chemically synthesized
aaggaaugugacuuccaga

SEQ ID NO: 12622 - RNA, 19 nt, artificial
  Chemically synthesized
gcuccagauuguagggcag

SEQ ID NO: 12623 - RNA, 19 nt, artificial
  Chemically synthesized
gcugagaagccuuuacagg

SEQ ID NO: 12624 - RNA, 19 nt, artificial
  Chemically synthesized
acagacucacauacagaca

SEQ ID NO: 12625 - RNA, 19 nt, artificial
  Chemically synthesized
gaggaagcgcuggcagaca

SEQ ID NO: 12626 - RNA, 19 nt, artificial
  Chemically synthesized
agagagcugcuuaaacuca

SEQ ID NO: 12627 - RNA, 19 nt, artificial
  Chemically synthesized
uuuuuguucagggacaugg

SEQ ID NO: 12628 - RNA, 19 nt, artificial
  Chemically synthesized
auguaguccagcaacagcc

SEQ ID NO: 12629 - RNA, 19 nt, artificial
  Chemically synthesized
uuagagguauaaauacugg

SEQ ID NO: 12630 - RNA, 19 nt, artificial
  Chemically synthesized
ucuuagucucagcuggucc

SEQ ID NO: 12631 - RNA, 19 nt, artificial
  Chemically synthesized
uauuccaggauauaggaag

SEQ ID NO: 12632 - RNA, 19 nt, artificial
  Chemically synthesized
aauacugguacauuggguc

SEQ ID NO: 12633 - RNA, 19 nt, artificial
  Chemically synthesized
auauauuccaggauauagg

SEQ ID NO: 12634 - RNA, 19 nt, artificial
  Chemically synthesized
ucauacuugaugaauaugc

SEQ ID NO: 12635 - RNA, 19 nt, artificial
  Chemically synthesized
uacccuugaggucucgagg

SEQ ID NO: 12636 - RNA, 19 nt, artificial
  Chemically synthesized
ucuccaaguacucaaaguc

SEQ ID NO: 12637 - RNA, 19 nt, artificial
  Chemically synthesized
aaaacauguagaagaugcc

SEQ ID NO: 12638 - RNA, 19 nt, artificial
  Chemically synthesized
uuuucuauuggauuuaggg

SEQ ID NO: 12639 - RNA, 19 nt, artificial
  Chemically synthesized
aacauguagaagaugccuc

SEQ ID NO: 12640 - RNA, 19 nt, artificial
  Chemically synthesized
uucuucauugccuuguacu

SEQ ID NO: 12641 - RNA, 19 nt, artificial
  Chemically synthesized
uuugguuucaaugaguagg

SEQ ID NO: 12642 - RNA, 19 nt, artificial
  Chemically synthesized
uucucaugccagguggagc

SEQ ID NO: 12643 - RNA, 19 nt, artificial
  Chemically synthesized
uagagguauaaauacuggu

SEQ ID NO: 12644 - RNA, 19 nt, artificial
  Chemically synthesized
uacuugaugaauaugccag

SEQ ID NO: 12645 - RNA, 19 nt, artificial
  Chemically synthesized
auaaauacugguacauugg

SEQ ID NO: 12646 - RNA, 19 nt, artificial
  Chemically synthesized
uucuccugcggcacccgcc

SEQ ID NO: 12647 - RNA, 19 nt, artificial
  Chemically synthesized
uaggaaauaaggcucaagg

SEQ ID NO: 12648 - RNA, 19 nt, artificial
  Chemically synthesized
agcuacucucuguucuccc

SEQ ID NO: 12649 - RNA, 19 nt, artificial
  Chemically synthesized
uugugucuccaguugccgg

SEQ ID NO: 12650 - RNA, 19 nt, artificial
  Chemically synthesized
uauaaacucaggaugcaag

SEQ ID NO: 12651 - RNA, 19 nt, artificial
  Chemically synthesized
uucaagauauacuuuuggc

SEQ ID NO: 12652 - RNA, 19 nt, artificial
  Chemically synthesized
uuugucuguuccaguugcc

SEQ ID NO: 12653 - RNA, 19 nt, artificial
  Chemically synthesized
uuuccgagaagcgccgccc

SEQ ID NO: 12654 - RNA, 19 nt, artificial
  Chemically synthesized
uugagagguaaguagagca

SEQ ID NO: 12655 - RNA, 19 nt, artificial
  Chemically synthesized
ucucugugcuucauuagag

SEQ ID NO: 12656 - RNA, 19 nt, artificial
  Chemically synthesized
aauuuggucuggaagucac

SEQ ID NO: 12657 - RNA, 19 nt, artificial
  Chemically synthesized
auugagagguaaguagagc

SEQ ID NO: 12658 - RNA, 19 nt, artificial
  Chemically synthesized
auugccuuguacuugaugg

SEQ ID NO: 12659 - RNA, 19 nt, artificial
  Chemically synthesized
uagaccagacacaggugcc

SEQ ID NO: 12660 - RNA, 19 nt, artificial
  Chemically synthesized
uggucuggaagucacauuc

SEQ ID NO: 12661 - RNA, 19 nt, artificial
  Chemically synthesized
uaaaggcuucucagccucc

SEQ ID NO: 12662 - RNA, 19 nt, artificial
  Chemically synthesized
uuguugugugaguuuaagc

SEQ ID NO: 12663 - RNA, 19 nt, artificial
  Chemically synthesized
uugggcugggccaaacugc

SEQ ID NO: 12664 - RNA, 19 nt, artificial
  Chemically synthesized
aaaggaauagaugagugcc

SEQ ID NO: 12665 - RNA, 19 nt, artificial
  Chemically synthesized
ugugagucuguaugugccc

SEQ ID NO: 12666 - RNA, 19 nt, artificial
  Chemically synthesized
aaguacucaaaguccaucu

SEQ ID NO: 12667 - RNA, 19 nt, artificial
  Chemically synthesized
auacuuuuggcaauccucc

SEQ ID NO: 12668 - RNA, 19 nt, artificial
  Chemically synthesized
uugguuucaaugaguaggg

SEQ ID NO: 12669 - RNA, 19 nt, artificial
  Chemically synthesized
augugagucuguaugugcc

SEQ ID NO: 12670 - RNA, 19 nt, artificial
  Chemically synthesized
uuucccaccuagcuguucc

SEQ ID NO: 12671 - RNA, 19 nt, artificial
  Chemically synthesized
uugaugaauaugccagagg

SEQ ID NO: 12672 - RNA, 19 nt, artificial
  Chemically synthesized
uacucaaaguccaucuccu

SEQ ID NO: 12673 - RNA, 19 nt, artificial
  Chemically synthesized
uucuauaguguccuggcug

SEQ ID NO: 12674 - RNA, 19 nt, artificial
  Chemically synthesized
ucgcagacagugaugaacc

SEQ ID NO: 12675 - RNA, 19 nt, artificial
  Chemically synthesized
ucgcuuuccgagaagcgcc

SEQ ID NO: 12676 - RNA, 19 nt, artificial
  Chemically synthesized
uucagggacaugguuaggc

SEQ ID NO: 12677 - RNA, 19 nt, artificial
  Chemically synthesized
ugguccuucuuagucucag

SEQ ID NO: 12678 - RNA, 19 nt, artificial
  Chemically synthesized
uuaggaaauaaggcucaag

SEQ ID NO: 12679 - RNA, 19 nt, artificial
  Chemically synthesized
uugccuuguacuugauggg

SEQ ID NO: 12680 - RNA, 19 nt, artificial
  Chemically synthesized
aaggaauagaugagugccc

SEQ ID NO: 12681 - RNA, 19 nt, artificial
  Chemically synthesized
aacucuuucuucauugccu

SEQ ID NO: 12682 - RNA, 19 nt, artificial
  Chemically synthesized
uaguccagcaacagccagc

SEQ ID NO: 12683 - RNA, 19 nt, artificial
  Chemically synthesized
aucaucagagacaaccacc

SEQ ID NO: 12684 - RNA, 19 nt, artificial
  Chemically synthesized
uucgcuuuccgagaagcgc

SEQ ID NO: 12685 - RNA, 19 nt, artificial
  Chemically synthesized
acaaccaccaccauccggc

SEQ ID NO: 12686 - RNA, 19 nt, artificial
  Chemically synthesized
ugcccuacaaucuggagcc

SEQ ID NO: 12687 - RNA, 19 nt, artificial
  Chemically synthesized
aaauaucggcuuuucucag

SEQ ID NO: 12688 - RNA, 19 nt, artificial
  Chemically synthesized
ugagaguacaugucuguac

SEQ ID NO: 12689 - RNA, 19 nt, artificial
  Chemically synthesized
aaaguccaucuccuccgcc

SEQ ID NO: 12690 - RNA, 19 nt, artificial
  Chemically synthesized
aaauacugguacauugggu

SEQ ID NO: 12691 - RNA, 19 nt, artificial
  Chemically synthesized
ugcugguccuucuuagucu

SEQ ID NO: 12692 - RNA, 19 nt, artificial
  Chemically synthesized
ucaaacacagcuacucucu

SEQ ID NO: 12693 - RNA, 19 nt, artificial
  Chemically synthesized
ugccucaacaagaucaugc

SEQ ID NO: 12694 - RNA, 19 nt, artificial
  Chemically synthesized
ugaaguuggcaucuccagg

SEQ ID NO: 12695 - RNA, 19 nt, artificial
  Chemically synthesized
uuaaugcguacaaaacaug

SEQ ID NO: 12696 - RNA, 19 nt, artificial
  Chemically synthesized
cauacuugaugaauaugcc

SEQ ID NO: 12697 - RNA, 19 nt, artificial
  Chemically synthesized
uuuuguucagggacauggu

SEQ ID NO: 12698 - RNA, 19 nt, artificial
  Chemically synthesized
uguucuauaguguccuggc

SEQ ID NO: 12699 - RNA, 19 nt, artificial
  Chemically synthesized
ugaaagaugcagaugagag

SEQ ID NO: 12700 - RNA, 19 nt, artificial
  Chemically synthesized
ugaugaauaugccagaggc

SEQ ID NO: 12701 - RNA, 19 nt, artificial
  Chemically synthesized
ugcacaaacuggaugucgc

SEQ ID NO: 12702 - RNA, 19 nt, artificial
  Chemically synthesized
uuucgcuuuccgagaagcg

SEQ ID NO: 12703 - RNA, 19 nt, artificial
  Chemically synthesized
auugucugccagcgcuucc

SEQ ID NO: 12704 - RNA, 19 nt, artificial
  Chemically synthesized
aaagguaccuugcuccagc

SEQ ID NO: 12705 - RNA, 19 nt, artificial
  Chemically synthesized
cuacccuugaggucucgag

SEQ ID NO: 12706 - RNA, 19 nt, artificial
  Chemically synthesized
aaaguauaaauugcucugg

SEQ ID NO: 12707 - RNA, 19 nt, artificial
  Chemically synthesized
aaugcugggucccagcucc

SEQ ID NO: 12708 - RNA, 19 nt, artificial
  Chemically synthesized
aaacgcucaggcauaugcc

SEQ ID NO: 12709 - RNA, 19 nt, artificial
  Chemically synthesized
ugaaaugugauguccagcu

SEQ ID NO: 12710 - RNA, 19 nt, artificial
  Chemically synthesized
acaaacuggaugucgcugg

SEQ ID NO: 12711 - RNA, 19 nt, artificial
  Chemically synthesized
ccuucuuagucucagcugg

SEQ ID NO: 12712 - RNA, 19 nt, artificial
  Chemically synthesized
accuguaaaggcuucucag

SEQ ID NO: 12713 - RNA, 19 nt, artificial
  Chemically synthesized
uuccucuuucuccugcggc

SEQ ID NO: 12714 - RNA, 19 nt, artificial
  Chemically synthesized
aacaagaucaugcagagag

SEQ ID NO: 12715 - RNA, 19 nt, artificial
  Chemically synthesized
ucuuucuccugcggcaccc

SEQ ID NO: 12716 - RNA, 19 nt, artificial
  Chemically synthesized
ugugucuguaugugagucu

SEQ ID NO: 12717 - RNA, 19 nt, artificial
  Chemically synthesized
ugucuguacauauaugugu

SEQ ID NO: 12718 - RNA, 19 nt, artificial
  Chemically synthesized
uugucacugcugaagguug

SEQ ID NO: 12719 - RNA, 19 nt, artificial
  Chemically synthesized
aaacugagggugaagaugu

SEQ ID NO: 12720 - RNA, 19 nt, artificial
  Chemically synthesized
uucagucgauaguuugucu

SEQ ID NO: 12721 - RNA, 19 nt, artificial
  Chemically synthesized
uguaugugcccaugugccc

SEQ ID NO: 12722 - RNA, 19 nt, artificial
  Chemically synthesized
auucaaacacagcuacucu

SEQ ID NO: 12723 - RNA, 19 nt, artificial
  Chemically synthesized
uuagucucagcugguccug

SEQ ID NO: 12724 - RNA, 19 nt, artificial
  Chemically synthesized
auaugugugugucuguaug

SEQ ID NO: 12725 - RNA, 19 nt, artificial
  Chemically synthesized
aaguggagcaaagauaugc

SEQ ID NO: 12726 - RNA, 19 nt, artificial
  Chemically synthesized
caagugaggaaacugaggg

SEQ ID NO: 12727 - RNA, 19 nt, artificial
  Chemically synthesized
uauaaauugcucugggaag

SEQ ID NO: 12728 - RNA, 19 nt, artificial
  Chemically synthesized
cuguaaaggcuucucagcc

SEQ ID NO: 12729 - RNA, 19 nt, artificial
  Chemically synthesized
ugcaguucauuguugugug

SEQ ID NO: 12730 - RNA, 19 nt, artificial
  Chemically synthesized
aucuccaggaauugagagg

SEQ ID NO: 12731 - RNA, 19 nt, artificial
  Chemically synthesized
aaaaggaauagaugagugc

SEQ ID NO: 12732 - RNA, 19 nt, artificial
  Chemically synthesized
uugugugaguuuaagcagc

SEQ ID NO: 12733 - RNA, 19 nt, artificial
  Chemically synthesized
guagagcacagauuccucc

SEQ ID NO: 12734 - RNA, 19 nt, artificial
  Chemically synthesized
ugaagaugugugaauggcu

SEQ ID NO: 12735 - RNA, 19 nt, artificial
  Chemically synthesized
aaaugccucaacaagauca

SEQ ID NO: 12736 - RNA, 19 nt, artificial
  Chemically synthesized
ucagggacaugguuaggcu

SEQ ID NO: 12737 - RNA, 19 nt, artificial
  Chemically synthesized
aacguguguaugcuggugc

SEQ ID NO: 12738 - RNA, 19 nt, artificial
  Chemically synthesized
auguagaagaugccucuug

SEQ ID NO: 12739 - RNA, 19 nt, artificial
  Chemically synthesized
ucaucuccugcacaaacug

SEQ ID NO: 12740 - RNA, 19 nt, artificial
  Chemically synthesized
uguaccuagaaaaacgugu

SEQ ID NO: 12741 - RNA, 19 nt, artificial
  Chemically synthesized
ucaagauauacuuuuggca

SEQ ID NO: 12742 - RNA, 19 nt, artificial
  Chemically synthesized
auacugguacauugggucc

SEQ ID NO: 12743 - RNA, 19 nt, artificial
  Chemically synthesized
aaacauguagaagaugccu

SEQ ID NO: 12744 - RNA, 19 nt, artificial
  Chemically synthesized
uguuccugggagcuguacc

SEQ ID NO: 12745 - RNA, 19 nt, artificial
  Chemically synthesized
uugguguagucgcagacag

SEQ ID NO: 12746 - RNA, 19 nt, artificial
  Chemically synthesized
aaguauaaauugcucuggg

SEQ ID NO: 12747 - RNA, 19 nt, artificial
  Chemically synthesized
ugucuguuccaguugccgg

SEQ ID NO: 12748 - RNA, 19 nt, artificial
  Chemically synthesized
augaguagggacacaagag

SEQ ID NO: 12749 - RNA, 19 nt, artificial
  Chemically synthesized
uuggucuggaagucacauu

SEQ ID NO: 12750 - RNA, 19 nt, artificial
  Chemically synthesized
ucaucaaguguggugaugc

SEQ ID NO: 12751 - RNA, 19 nt, artificial
  Chemically synthesized
augucuguacauauaugug

SEQ ID NO: 12752 - RNA, 19 nt, artificial
  Chemically synthesized
uugguaagcagcucgagca

SEQ ID NO: 12753 - RNA, 19 nt, artificial
  Chemically synthesized
agaccauggcaccuucucc

SEQ ID NO: 12754 - RNA, 19 nt, artificial
  Chemically synthesized
uacauuggguccuuuccag

SEQ ID NO: 12755 - RNA, 19 nt, artificial
  Chemically synthesized
uagaaaaacguguguaugc

SEQ ID NO: 12756 - RNA, 19 nt, artificial
  Chemically synthesized
ucaguaggcaucacugugg

SEQ ID NO: 12757 - RNA, 19 nt, artificial
  Chemically synthesized
uuuguaaggcaaucaaggu

SEQ ID NO: 12758 - RNA, 19 nt, artificial
  Chemically synthesized
auaaauugcucugggaagg

SEQ ID NO: 12759 - RNA, 19 nt, artificial
  Chemically synthesized
uugucuguuccaguugccg

SEQ ID NO: 12760 - RNA, 19 nt, artificial
  Chemically synthesized
aauggcucagagcugagcu

SEQ ID NO: 12761 - RNA, 19 nt, artificial
  Chemically synthesized
augaaccucaggaugcugg

SEQ ID NO: 12762 - RNA, 19 nt, artificial
  Chemically synthesized
aaaugcccaguauuaaagg

SEQ ID NO: 12763 - RNA, 19 nt, artificial
  Chemically synthesized
uguaugugagucuguaugu

SEQ ID NO: 12764 - RNA, 19 nt, artificial
  Chemically synthesized
ugagagguaaguagagcac

SEQ ID NO: 12765 - RNA, 19 nt, artificial
  Chemically synthesized
ucaagugaggaaacugagg

SEQ ID NO: 12766 - RNA, 19 nt, artificial
  Chemically synthesized
uguugugugaguuuaagca

SEQ ID NO: 12767 - RNA, 19 nt, artificial
  Chemically synthesized
uagagcacagauuccuccu

SEQ ID NO: 12768 - RNA, 19 nt, artificial
  Chemically synthesized
acucacagccacugguucc

SEQ ID NO: 12769 - RNA, 19 nt, artificial
  Chemically synthesized
acccauuaggaaauaaggc

SEQ ID NO: 12770 - RNA, 19 nt, artificial
  Chemically synthesized
ugcugcuucaagauauacu

SEQ ID NO: 12771 - RNA, 19 nt, artificial
  Chemically synthesized
uaauccagcaaguggacau

SEQ ID NO: 12772 - RNA, 19 nt, artificial
  Chemically synthesized
agaaaagguaccuugcucc

SEQ ID NO: 12773 - RNA, 19 nt, artificial
  Chemically synthesized
uacacacacacccagggcc

SEQ ID NO: 12774 - RNA, 19 nt, artificial
  Chemically synthesized
acauguagaagaugccucu

SEQ ID NO: 12775 - RNA, 19 nt, artificial
  Chemically synthesized
uaaucaucagagacaacca

SEQ ID NO: 12776 - RNA, 19 nt, artificial
  Chemically synthesized
uucaccauuuccuacaggg

SEQ ID NO: 12777 - RNA, 19 nt, artificial
  Chemically synthesized
auaguuugucuguuccagu

SEQ ID NO: 12778 - RNA, 19 nt, artificial
  Chemically synthesized
agcaacagccagcucuccc

SEQ ID NO: 12779 - RNA, 19 nt, artificial
  Chemically synthesized
ugcaaauuuggucuggaag

SEQ ID NO: 12780 - RNA, 19 nt, artificial
  Chemically synthesized
aucagagacaaccaccacc

SEQ ID NO: 12781 - RNA, 19 nt, artificial
  Chemically synthesized
uugucugccagcgcuuccu

SEQ ID NO: 12782 - RNA, 19 nt, artificial
  Chemically synthesized
uaaaugccucaacaagauc

SEQ ID NO: 12783 - RNA, 19 nt, artificial
  Chemically synthesized
aucuccugcacaaacugga

SEQ ID NO: 12784 - RNA, 19 nt, artificial
  Chemically synthesized
aaaaacguguguaugcugg

SEQ ID NO: 12785 - RNA, 19 nt, artificial
  Chemically synthesized
uggagcugagagcaugacc

SEQ ID NO: 12786 - RNA, 19 nt, artificial
  Chemically synthesized
aucaaguguggugaugccc

SEQ ID NO: 12787 - RNA, 19 nt, artificial
  Chemically synthesized
ugugugagaguacaugucu

SEQ ID NO: 12788 - RNA, 19 nt, artificial
  Chemically synthesized
uuucaaugaguagggacac

SEQ ID NO: 12789 - RNA, 19 nt, artificial
  Chemically synthesized
ucucaugccagguggagcu

SEQ ID NO: 12790 - RNA, 19 nt, artificial
  Chemically synthesized
uccuguucuauaguguccu

SEQ ID NO: 12791 - RNA, 19 nt, artificial
  Chemically synthesized
caaaacauguagaagaugc

SEQ ID NO: 12792 - RNA, 19 nt, artificial
  Chemically synthesized
uuucuccugcggcacccgc

SEQ ID NO: 12793 - RNA, 19 nt, artificial
  Chemically synthesized
uuggugggaaagcucucug

SEQ ID NO: 12794 - RNA, 19 nt, artificial
  Chemically synthesized
aaaugugauguccagcugc

SEQ ID NO: 12795 - RNA, 19 nt, artificial
  Chemically synthesized
aggcuucucagccuccucc

SEQ ID NO: 12796 - RNA, 19 nt, artificial
  Chemically synthesized
aauugagagguaaguagag

SEQ ID NO: 12797 - RNA, 19 nt, artificial
  Chemically synthesized
ugauaauccagcaagugga

SEQ ID NO: 12798 - RNA, 19 nt, artificial
  Chemically synthesized
augcaagauauauuccagg

SEQ ID NO: 12799 - RNA, 19 nt, artificial
  Chemically synthesized
acccuugaggucucgaggc

SEQ ID NO: 12800 - RNA, 19 nt, artificial
  Chemically synthesized
guaaguagagcacagauuc

SEQ ID NO: 12801 - RNA, 19 nt, artificial
  Chemically synthesized
aucuccaaguacucaaagu

SEQ ID NO: 12802 - RNA, 19 nt, artificial
  Chemically synthesized
caagguacaaaguuggugg

SEQ ID NO: 12803 - RNA, 19 nt, artificial
  Chemically synthesized
ucgggucgcauugucugcc

SEQ ID NO: 12804 - RNA, 19 nt, artificial
  Chemically synthesized
uggaagucacauuccuugc

SEQ ID NO: 12805 - RNA, 19 nt, artificial
  Chemically synthesized
uccagcagcacgucgucgc

SEQ ID NO: 12806 - RNA, 19 nt, artificial
  Chemically synthesized
uguaaaggcuucucagccu

SEQ ID NO: 12807 - RNA, 19 nt, artificial
  Chemically synthesized
ucacugcugaagguugggc

SEQ ID NO: 12808 - RNA, 19 nt, artificial
  Chemically synthesized
aaaaugcccaguauuaaag

SEQ ID NO: 12809 - RNA, 19 nt, artificial
  Chemically synthesized
uacagggauucaaacacag

SEQ ID NO: 12810 - RNA, 19 nt, artificial
  Chemically synthesized
uacauggacaggcagacag

SEQ ID NO: 12811 - RNA, 19 nt, artificial
  Chemically synthesized
uuuggucuggaagucacau

SEQ ID NO: 12812 - RNA, 19 nt, artificial
  Chemically synthesized
ugucugcaguucauuguug

SEQ ID NO: 12813 - RNA, 19 nt, artificial
  Chemically synthesized
ucgauaguuugucuguucc

SEQ ID NO: 12814 - RNA, 19 nt, artificial
  Chemically synthesized
acauauaugugugugucug

SEQ ID NO: 12815 - RNA, 19 nt, artificial
  Chemically synthesized
uccgcuugugucuccaguu

SEQ ID NO: 12816 - RNA, 19 nt, artificial
  Chemically synthesized
gacagauacacacacaccc

SEQ ID NO: 12817 - RNA, 19 nt, artificial
  Chemically synthesized
uugccggaucuccaaguac

SEQ ID NO: 12818 - RNA, 19 nt, artificial
  Chemically synthesized
uagcaauagaccagacaca

SEQ ID NO: 12819 - RNA, 19 nt, artificial
  Chemically synthesized
gagcucacuagcaauagac

SEQ ID NO: 12820 - RNA, 19 nt, artificial
  Chemically synthesized
acagcuacucucuguucuc

SEQ ID NO: 12821 - RNA, 19 nt, artificial
  Chemically synthesized
uugggcagaagcugggagg

SEQ ID NO: 12822 - RNA, 19 nt, artificial
  Chemically synthesized
aaauaaggcucaagguggg

SEQ ID NO: 12823 - RNA, 19 nt, artificial
  Chemically synthesized
acagccacugguuccaugc

SEQ ID NO: 12824 - RNA, 19 nt, artificial
  Chemically synthesized
gaaauaaggcucaaggugg

SEQ ID NO: 12825 - RNA, 19 nt, artificial
  Chemically synthesized
agcucacuagcaauagacc

SEQ ID NO: 12826 - RNA, 19 nt, artificial
  Chemically synthesized
uccaaguacucaaagucca

SEQ ID NO: 12827 - RNA, 19 nt, artificial
  Chemically synthesized
cuugugucuccaguugccg

SEQ ID NO: 12828 - RNA, 19 nt, artificial
  Chemically synthesized
aucauuacagugacucauc

SEQ ID NO: 12829 - RNA, 19 nt, artificial
  Chemically synthesized
guccuucuuagucucagcu

SEQ ID NO: 12830 - RNA, 19 nt, artificial
  Chemically synthesized
gaacucuuucuucauugcc

SEQ ID NO: 12831 - RNA, 19 nt, artificial
  Chemically synthesized
uggcugauaauccagcaag

SEQ ID NO: 12832 - RNA, 19 nt, artificial
  Chemically synthesized
uccagcaacagccagcucu

SEQ ID NO: 12833 - RNA, 19 nt, artificial
  Chemically synthesized
ugaaccucaggaugcuggg

SEQ ID NO: 12834 - RNA, 19 nt, artificial
  Chemically synthesized
uccagcaaguggacaugcc

SEQ ID NO: 12835 - RNA, 19 nt, artificial
  Chemically synthesized
auuuggucuggaagucaca

SEQ ID NO: 12836 - RNA, 19 nt, artificial
  Chemically synthesized
aaugcccaguauuaaaggg

SEQ ID NO: 12837 - RNA, 19 nt, artificial
  Chemically synthesized
uugccggaucaucuccugc

SEQ ID NO: 12838 - RNA, 19 nt, artificial
  Chemically synthesized
caauagaccagacacaggu

SEQ ID NO: 12839 - RNA, 19 nt, artificial
  Chemically synthesized
uauauuccaggauauagga

SEQ ID NO: 12840 - RNA, 19 nt, artificial
  Chemically synthesized
aucaguaggcaucacugug

SEQ ID NO: 12841 - RNA, 19 nt, artificial
  Chemically synthesized
ucccuucucaugccaggug

SEQ ID NO: 12842 - RNA, 19 nt, artificial
  Chemically synthesized
guguccuggcugauaaucc

SEQ ID NO: 12843 - RNA, 19 nt, artificial
  Chemically synthesized
aucaucuccugcacaaacu

SEQ ID NO: 12844 - RNA, 19 nt, artificial
  Chemically synthesized
aaacucaggaugcaagaua

SEQ ID NO: 12845 - RNA, 19 nt, artificial
  Chemically synthesized
ugugugugagaguacaugu

SEQ ID NO: 12846 - RNA, 19 nt, artificial
  Chemically synthesized
agaauggcaaauaucggcu

SEQ ID NO: 12847 - RNA, 19 nt, artificial
  Chemically synthesized
ugugcuucauuagagguau

SEQ ID NO: 12848 - RNA, 19 nt, artificial
  Chemically synthesized
aucgcggucagacacacac

SEQ ID NO: 12849 - RNA, 19 nt, artificial
  Chemically synthesized
ugucacugcugaagguugg

SEQ ID NO: 12850 - RNA, 19 nt, artificial
  Chemically synthesized
aaggcuucucagccuccuc

SEQ ID NO: 12851 - RNA, 19 nt, artificial
  Chemically synthesized
ugggaggugugaaagaugc

SEQ ID NO: 12852 - RNA, 19 nt, artificial
  Chemically synthesized
ugugugaauggcucagagc

SEQ ID NO: 12853 - RNA, 19 nt, artificial
  Chemically synthesized
ugugucuccaguugccgga

SEQ ID NO: 12854 - RNA, 19 nt, artificial
  Chemically synthesized
ugaagcaucaguaggcauc

SEQ ID NO: 12855 - RNA, 19 nt, artificial
  Chemically synthesized
augugugugucuguaugug

SEQ ID NO: 12856 - RNA, 19 nt, artificial
  Chemically synthesized
ucucucugugcuucauuag

SEQ ID NO: 12857 - RNA, 19 nt, artificial
  Chemically synthesized
uacauauaugugugugucu

SEQ ID NO: 12858 - RNA, 19 nt, artificial
  Chemically synthesized
ugcagaugagagguggacc

SEQ ID NO: 12859 - RNA, 19 nt, artificial
  Chemically synthesized
ucgcauguugagagcagcc

SEQ ID NO: 12860 - RNA, 19 nt, artificial
  Chemically synthesized
ugagugcaaauuuggucug

SEQ ID NO: 12861 - RNA, 19 nt, artificial
  Chemically synthesized
uucucagccuccuccugcu

SEQ ID NO: 12862 - RNA, 19 nt, artificial
  Chemically synthesized
cuuuucucagauaucuuug

SEQ ID NO: 12863 - RNA, 19 nt, artificial
  Chemically synthesized
uguucagggacaugguuag

SEQ ID NO: 12864 - RNA, 19 nt, artificial
  Chemically synthesized
aaacacagcuacucucugu

SEQ ID NO: 12865 - RNA, 19 nt, artificial
  Chemically synthesized
uucgaugagcucacuagca

SEQ ID NO: 12866 - RNA, 19 nt, artificial
  Chemically synthesized
aagguaccuugcuccagcc

SEQ ID NO: 12867 - RNA, 19 nt, artificial
  Chemically synthesized
uccaguugccggaucaucu

SEQ ID NO: 12868 - RNA, 19 nt, artificial
  Chemically synthesized
ucggcuuuucucagauauc

SEQ ID NO: 12869 - RNA, 19 nt, artificial
  Chemically synthesized
augcaggacaugaaaugug

SEQ ID NO: 12870 - RNA, 19 nt, artificial
  Chemically synthesized
aucccuucucaugccaggu

SEQ ID NO: 12871 - RNA, 19 nt, artificial
  Chemically synthesized
ugccggaucuccaaguacu

SEQ ID NO: 12872 - RNA, 19 nt, artificial
  Chemically synthesized
aaguggacaugccacucac

SEQ ID NO: 12873 - RNA, 19 nt, artificial
  Chemically synthesized
gguccuucuuagucucagc

SEQ ID NO: 12874 - RNA, 19 nt, artificial
  Chemically synthesized
ugcauggcagcuaaaugcc

SEQ ID NO: 12875 - RNA, 19 nt, artificial
  Chemically synthesized
ugugaguuuaagcagcucu

SEQ ID NO: 12876 - RNA, 19 nt, artificial
  Chemically synthesized
uuauaaacucaggaugcaa

SEQ ID NO: 12877 - RNA, 19 nt, artificial
  Chemically synthesized
auacuugaugaauaugcca

SEQ ID NO: 12878 - RNA, 19 nt, artificial
  Chemically synthesized
accucuacccuugaggucu

SEQ ID NO: 12879 - RNA, 19 nt, artificial
  Chemically synthesized
aguagagcacagauuccuc

SEQ ID NO: 12880 - RNA, 19 nt, artificial
  Chemically synthesized
ucguggucacagcaguggc

SEQ ID NO: 12881 - RNA, 19 nt, artificial
  Chemically synthesized
uguguccgcacguucaaga

SEQ ID NO: 12882 - RNA, 19 nt, artificial
  Chemically synthesized
ucaaguguggugaugcccg

SEQ ID NO: 12883 - RNA, 19 nt, artificial
  Chemically synthesized
uccaguugccggaucucca

SEQ ID NO: 12884 - RNA, 19 nt, artificial
  Chemically synthesized
ucucccgcagccaagccug

SEQ ID NO: 12885 - RNA, 19 nt, artificial
  Chemically synthesized
uagaugagugcccaauuuu

SEQ ID NO: 12886 - RNA, 19 nt, artificial
  Chemically synthesized
agcuguaccuagaaaaacg

SEQ ID NO: 12887 - RNA, 19 nt, artificial
  Chemically synthesized
auauacuuuuggcaauccu

SEQ ID NO: 12888 - RNA, 19 nt, artificial
  Chemically synthesized
uuguucagggacaugguua

SEQ ID NO: 12889 - RNA, 19 nt, artificial
  Chemically synthesized
ugagucuguaugugcccau

SEQ ID NO: 12890 - RNA, 19 nt, artificial
  Chemically synthesized
ucagugaugggacuuuccc

SEQ ID NO: 12891 - RNA, 19 nt, artificial
  Chemically synthesized
acaugucuguacauauaug

SEQ ID NO: 12892 - RNA, 19 nt, artificial
  Chemically synthesized
ugugugugucuguauguga

SEQ ID NO: 12893 - RNA, 19 nt, artificial
  Chemically synthesized
augaaaugugauguccagc

SEQ ID NO: 12894 - RNA, 19 nt, artificial
  Chemically synthesized
cuuuguaaggcaaucaagg

SEQ ID NO: 12895 - RNA, 19 nt, artificial
  Chemically synthesized
ugugagaguacaugucugu

SEQ ID NO: 12896 - RNA, 19 nt, artificial
  Chemically synthesized
uccuccucaaugcuggguc

SEQ ID NO: 12897 - RNA, 19 nt, artificial
  Chemically synthesized
cugagugcaaauuuggucu

SEQ ID NO: 12898 - RNA, 19 nt, artificial
  Chemically synthesized
uagucucagcugguccugu

SEQ ID NO: 12899 - RNA, 19 nt, artificial
  Chemically synthesized
aagagaaaaggaauagaug

SEQ ID NO: 12900 - RNA, 19 nt, artificial
  Chemically synthesized
uacugguacauuggguccu

SEQ ID NO: 12901 - RNA, 19 nt, artificial
  Chemically synthesized
ucuguaugugagucuguau

SEQ ID NO: 12902 - RNA, 19 nt, artificial
  Chemically synthesized
aucuccuccgccagcgcgg

SEQ ID NO: 12903 - RNA, 19 nt, artificial
  Chemically synthesized
acugguuccaugcaggaca

SEQ ID NO: 12904 - RNA, 19 nt, artificial
  Chemically synthesized
uacuuuuggcaauccuccu

SEQ ID NO: 12905 - RNA, 19 nt, artificial
  Chemically synthesized
ugcucugcagguaaucauc

SEQ ID NO: 12906 - RNA, 19 nt, artificial
  Chemically synthesized
uccucaagugaggaaacug

SEQ ID NO: 12907 - RNA, 19 nt, artificial
  Chemically synthesized
agcaauagaccagacacag

SEQ ID NO: 12908 - RNA, 19 nt, artificial
  Chemically synthesized
aaaggcuucucagccuccu

SEQ ID NO: 12909 - RNA, 19 nt, artificial
  Chemically synthesized
gagacaaccaccaccaucc

SEQ ID NO: 12910 - RNA, 19 nt, artificial
  Chemically synthesized
acucuuucuucauugccuu

SEQ ID NO: 12911 - RNA, 19 nt, artificial
  Chemically synthesized
cauuacagugacucauccc

SEQ ID NO: 12912 - RNA, 19 nt, artificial
  Chemically synthesized
uuaggcucccucagugaug

SEQ ID NO: 12913 - RNA, 19 nt, artificial
  Chemically synthesized
ucagagacaaccaccacca

SEQ ID NO: 12914 - RNA, 19 nt, artificial
  Chemically synthesized
auaucggcuuuucucagau

SEQ ID NO: 12915 - RNA, 19 nt, artificial
  Chemically synthesized
aggcugagugcaaauuugg

SEQ ID NO: 12916 - RNA, 19 nt, artificial
  Chemically synthesized
auguugagagcagccaggg

SEQ ID NO: 12917 - RNA, 19 nt, artificial
  Chemically synthesized
uuccuacagggauucaaac

SEQ ID NO: 12918 - RNA, 19 nt, artificial
  Chemically synthesized
uaaugcguacaaaacaugu

SEQ ID NO: 12919 - RNA, 19 nt, artificial
  Chemically synthesized
uuucuauuggauuuagggu

SEQ ID NO: 12920 - RNA, 19 nt, artificial
  Chemically synthesized
uuggcaauccuccucaaug

SEQ ID NO: 12921 - RNA, 19 nt, artificial
  Chemically synthesized
ugcucugggaaggagagag

SEQ ID NO: 12922 - RNA, 19 nt, artificial
  Chemically synthesized
aagaccauggcaccuucuc

SEQ ID NO: 12923 - RNA, 19 nt, artificial
  Chemically synthesized
aagguugggcagaagcugg

SEQ ID NO: 12924 - RNA, 19 nt, artificial
  Chemically synthesized
caaauuuggucuggaaguc

SEQ ID NO: 12925 - RNA, 19 nt, artificial
  Chemically synthesized
aggcaaucaagguacaaag

SEQ ID NO: 12926 - RNA, 19 nt, artificial
  Chemically synthesized
acaaauaacuuuguaaggc

SEQ ID NO: 12927 - RNA, 19 nt, artificial
  Chemically synthesized
caugucuguacauauaugu

SEQ ID NO: 12928 - RNA, 19 nt, artificial
  Chemically synthesized
uaggguccuagggucuguc

SEQ ID NO: 12929 - RNA, 19 nt, artificial
  Chemically synthesized
ugggcugggccaaacugcu

SEQ ID NO: 12930 - RNA, 19 nt, artificial
  Chemically synthesized
agacccagagcuaugcuuc

SEQ ID NO: 12931 - RNA, 19 nt, artificial
  Chemically synthesized
aauugcucugggaaggaga

SEQ ID NO: 12932 - RNA, 19 nt, artificial
  Chemically synthesized
ucagaacagucuucagggc

SEQ ID NO: 12933 - RNA, 19 nt, artificial
  Chemically synthesized
ucuccaggaauugagaggu

SEQ ID NO: 12934 - RNA, 19 nt, artificial
  Chemically synthesized
auacacacacacccagggc

SEQ ID NO: 12935 - RNA, 19 nt, artificial
  Chemically synthesized
ugugcccacaagcuuuggg

SEQ ID NO: 12936 - RNA, 19 nt, artificial
  Chemically synthesized
acacacacaacuucagucg

SEQ ID NO: 12937 - RNA, 19 nt, artificial
  Chemically synthesized
ucaucagagacaaccacca

SEQ ID NO: 12938 - RNA, 19 nt, artificial
  Chemically synthesized
ucaaugaguagggacacaa

SEQ ID NO: 12939 - RNA, 19 nt, artificial
  Chemically synthesized
aucacuguggaagaagcug

SEQ ID NO: 12940 - RNA, 19 nt, artificial
  Chemically synthesized
ucaacaagaucaugcagag

SEQ ID NO: 12941 - RNA, 19 nt, artificial
  Chemically synthesized
ucaggaugcaagauauauu

SEQ ID NO: 12942 - RNA, 19 nt, artificial
  Chemically synthesized
ucacauuccuugcucugca

SEQ ID NO: 12943 - RNA, 19 nt, artificial
  Chemically synthesized
uggacaugccacucacagc

SEQ ID NO: 12944 - RNA, 19 nt, artificial
  Chemically synthesized
uggaaaugaaaagcagccc

SEQ ID NO: 12945 - RNA, 19 nt, artificial
  Chemically synthesized
uaccuugcuccagccuggc

SEQ ID NO: 12946 - RNA, 19 nt, artificial
  Chemically synthesized
aacgcucaggcauaugccc

SEQ ID NO: 12947 - RNA, 19 nt, artificial
  Chemically synthesized
uggcucugcugguccuucu

SEQ ID NO: 12948 - RNA, 19 nt, artificial
  Chemically synthesized
acagauuccuccuacaacg

SEQ ID NO: 12949 - RNA, 19 nt, artificial
  Chemically synthesized
aggaggaaguggaaugggc

SEQ ID NO: 12950 - RNA, 19 nt, artificial
  Chemically synthesized
aaugaguagggacacaaga

SEQ ID NO: 12951 - RNA, 19 nt, artificial
  Chemically synthesized
caaauaucggcuuuucuca

SEQ ID NO: 12952 - RNA, 19 nt, artificial
  Chemically synthesized
agauacacacacacccagg

SEQ ID NO: 12953 - RNA, 19 nt, artificial
  Chemically synthesized
uagaagaugccucuugaga

SEQ ID NO: 12954 - RNA, 19 nt, artificial
  Chemically synthesized
ucgcauugucugccagcgc

SEQ ID NO: 12955 - RNA, 19 nt, artificial
  Chemically synthesized
ucuacccuugaggucucga

SEQ ID NO: 12956 - RNA, 19 nt, artificial
  Chemically synthesized
ucagucgcuucugaugggc

SEQ ID NO: 12957 - RNA, 19 nt, artificial
  Chemically synthesized
aauagcagaugaaggcauc

SEQ ID NO: 12958 - RNA, 19 nt, artificial
  Chemically synthesized
gacgugucugugaaguugg

SEQ ID NO: 12959 - RNA, 19 nt, artificial
  Chemically synthesized
aagucacauuccuugcucu

SEQ ID NO: 12960 - RNA, 19 nt, artificial
  Chemically synthesized
acuuuguaaggcaaucaag

SEQ ID NO: 12961 - RNA, 19 nt, artificial
  Chemically synthesized
uccagaaccaagauuuggu

SEQ ID NO: 12962 - RNA, 19 nt, artificial
  Chemically synthesized
agugaggaaacugagggug

SEQ ID NO: 12963 - RNA, 19 nt, artificial
  Chemically synthesized
ugccacucacagccacugg

SEQ ID NO: 12964 - RNA, 19 nt, artificial
  Chemically synthesized
uggugggaaagcucucugc

SEQ ID NO: 12965 - RNA, 19 nt, artificial
  Chemically synthesized
aaguccaucuccuccgcca

SEQ ID NO: 12966 - RNA, 19 nt, artificial
  Chemically synthesized
ugugauguccagcugcugc

SEQ ID NO: 12967 - RNA, 19 nt, artificial
  Chemically synthesized
ugcugcagacgugucugug

SEQ ID NO: 12968 - RNA, 19 nt, artificial
  Chemically synthesized
agagguaaguagagcacag

SEQ ID NO: 12969 - RNA, 19 nt, artificial
  Chemically synthesized
uuggcaucuccaggaauug

SEQ ID NO: 12970 - RNA, 19 nt, artificial
  Chemically synthesized
uguccgugggacacugcug

SEQ ID NO: 12971 - RNA, 19 nt, artificial
  Chemically synthesized
ccauuaggaaauaaggcuc

SEQ ID NO: 12972 - RNA, 19 nt, artificial
  Chemically synthesized
aguacaugucuguacauau

SEQ ID NO: 12973 - RNA, 19 nt, artificial
  Chemically synthesized
agcgcuuccucuuucuccu

SEQ ID NO: 12974 - RNA, 19 nt, artificial
  Chemically synthesized
gcaaauaucggcuuuucuc

SEQ ID NO: 12975 - RNA, 19 nt, artificial
  Chemically synthesized
ugagagcaugaccacaggc

SEQ ID NO: 12976 - RNA, 19 nt, artificial
  Chemically synthesized
uaaacucaggaugcaagau

SEQ ID NO: 12977 - RNA, 19 nt, artificial
  Chemically synthesized
aaagcucucugcagguggc

SEQ ID NO: 12978 - RNA, 19 nt, artificial
  Chemically synthesized
aacucaggaugcaagauau

SEQ ID NO: 12979 - RNA, 19 nt, artificial
  Chemically synthesized
ucagacacacacaacuuca

SEQ ID NO: 12980 - RNA, 19 nt, artificial
  Chemically synthesized
uguccgcacguucaagaac

SEQ ID NO: 12981 - RNA, 19 nt, artificial
  Chemically synthesized
ugugcagaggcacugaagc

SEQ ID NO: 12982 - RNA, 19 nt, artificial
  Chemically synthesized
augcguacaaaacauguag

SEQ ID NO: 12983 - RNA, 19 nt, artificial
  Chemically synthesized
aacagagacaggcggcgcc

SEQ ID NO: 12984 - RNA, 19 nt, artificial
  Chemically synthesized
aguugccggaucaucuccu

SEQ ID NO: 12985 - RNA, 19 nt, artificial
  Chemically synthesized
uggacaggcagacagauac

SEQ ID NO: 12986 - RNA, 19 nt, artificial
  Chemically synthesized
augccacucacagccacug

SEQ ID NO: 12987 - RNA, 19 nt, artificial
  Chemically synthesized
ugcccaugugcccacaagc

SEQ ID NO: 12988 - RNA, 19 nt, artificial
  Chemically synthesized
ucugugcuucauuagaggu

SEQ ID NO: 12989 - RNA, 19 nt, artificial
  Chemically synthesized
acaccuaagaccauggcac

SEQ ID NO: 12990 - RNA, 19 nt, artificial
  Chemically synthesized
aaauugcucugggaaggag

SEQ ID NO: 12991 - RNA, 19 nt, artificial
  Chemically synthesized
uugagauggcuuuaaaaug

SEQ ID NO: 12992 - RNA, 19 nt, artificial
  Chemically synthesized
cuccaaguacucaaagucc

SEQ ID NO: 12993 - RNA, 19 nt, artificial
  Chemically synthesized
agacagauacacacacacc

SEQ ID NO: 12994 - RNA, 19 nt, artificial
  Chemically synthesized
ucucagcugguccuguucu

SEQ ID NO: 12995 - RNA, 19 nt, artificial
  Chemically synthesized
aacacagcuacucucuguu

SEQ ID NO: 12996 - RNA, 19 nt, artificial
  Chemically synthesized
acugcugucuacagcggcc

SEQ ID NO: 12997 - RNA, 19 nt, artificial
  Chemically synthesized
acucaaaguccaucuccuc

SEQ ID NO: 12998 - RNA, 19 nt, artificial
  Chemically synthesized
cacaucauuacagugacuc

SEQ ID NO: 12999 - RNA, 19 nt, artificial
  Chemically synthesized
cuguaugugcccaugugcc

SEQ ID NO: 13000 - RNA, 19 nt, artificial
  Chemically synthesized
aauagaugagugcccaauu

SEQ ID NO: 13001 - RNA, 19 nt, artificial
  Chemically synthesized
uccaucuccuccgccagcg

SEQ ID NO: 13002 - RNA, 19 nt, artificial
  Chemically synthesized
cucacuagcaauagaccag

SEQ ID NO: 13003 - RNA, 19 nt, artificial
  Chemically synthesized
agaacagcugugucugcag

SEQ ID NO: 13004 - RNA, 19 nt, artificial
  Chemically synthesized
guaugugagucuguaugug

SEQ ID NO: 13005 - RNA, 19 nt, artificial
  Chemically synthesized
auuguugugugaguuuaag

SEQ ID NO: 13006 - RNA, 19 nt, artificial
  Chemically synthesized
aaguguggugaugcccgcc

SEQ ID NO: 13007 - RNA, 19 nt, artificial
  Chemically synthesized
uucagggcagggacaaggc

SEQ ID NO: 13008 - RNA, 19 nt, artificial
  Chemically synthesized
auaaacucaggaugcaaga

SEQ ID NO: 13009 - RNA, 19 nt, artificial
  Chemically synthesized
ugucuccaguugccggauc

SEQ ID NO: 13010 - RNA, 19 nt, artificial
  Chemically synthesized
cuagcaauagaccagacac

SEQ ID NO: 13011 - RNA, 19 nt, artificial
  Chemically synthesized
gacacugcugucuacagcg

SEQ ID NO: 13012 - RNA, 19 nt, artificial
  Chemically synthesized
uauaggaagaauggcaaau

SEQ ID NO: 13013 - RNA, 19 nt, artificial
  Chemically synthesized
auuuuuguucagggacaug

SEQ ID NO: 13014 - RNA, 19 nt, artificial
  Chemically synthesized
caccuguaaaggcuucuca

SEQ ID NO: 13015 - RNA, 19 nt, artificial
  Chemically synthesized
aaugccucaacaagaucau

SEQ ID NO: 13016 - RNA, 19 nt, artificial
  Chemically synthesized
ugaaggcaucgaaacgcuc

SEQ ID NO: 13017 - RNA, 19 nt, artificial
  Chemically synthesized
cuucagucgauaguuuguc

SEQ ID NO: 13018 - RNA, 19 nt, artificial
  Chemically synthesized
ugagauggcuuuaaaaugc

SEQ ID NO: 13019 - RNA, 19 nt, artificial
  Chemically synthesized
uuuguucagggacaugguu

SEQ ID NO: 13020 - RNA, 19 nt, artificial
  Chemically synthesized
ggacaugccacucacagcc

SEQ ID NO: 13021 - RNA, 19 nt, artificial
  Chemically synthesized
cacuguggaagaagcugcc

SEQ ID NO: 13022 - RNA, 19 nt, artificial
  Chemically synthesized
agagguauaaauacuggua

SEQ ID NO: 13023 - RNA, 19 nt, artificial
  Chemically synthesized
uuguaaggcaaucaaggua

SEQ ID NO: 13024 - RNA, 19 nt, artificial
  Chemically synthesized
ugugaaguuggcaucucca

SEQ ID NO: 13025 - RNA, 19 nt, artificial
  Chemically synthesized
caggaucccuucucaugcc

SEQ ID NO: 13026 - RNA, 19 nt, artificial
  Chemically synthesized
ugggacacugcugucuaca

SEQ ID NO: 13027 - RNA, 19 nt, artificial
  Chemically synthesized
cucagaacagucuucaggg

SEQ ID NO: 13028 - RNA, 19 nt, artificial
  Chemically synthesized
ugaagguugggcagaagcu

SEQ ID NO: 13029 - RNA, 19 nt, artificial
  Chemically synthesized
augagcucacuagcaauag

SEQ ID NO: 13030 - RNA, 19 nt, artificial
  Chemically synthesized
cagccaagccuggucuccc

SEQ ID NO: 13031 - RNA, 19 nt, artificial
  Chemically synthesized
uguacauauaugugugugu

SEQ ID NO: 13032 - RNA, 19 nt, artificial
  Chemically synthesized
agggacaugguuaggcucc

SEQ ID NO: 13033 - RNA, 19 nt, artificial
  Chemically synthesized
aauaucggcuuuucucaga

SEQ ID NO: 13034 - RNA, 19 nt, artificial
  Chemically synthesized
gaucccuucucaugccagg

SEQ ID NO: 13035 - RNA, 19 nt, artificial
  Chemically synthesized
ugagcuggcucugcugguc

SEQ ID NO: 13036 - RNA, 19 nt, artificial
  Chemically synthesized
agugaugggacuuucccac

SEQ ID NO: 13037 - RNA, 19 nt, artificial
  Chemically synthesized
gcugagugcaaauuugguc

SEQ ID NO: 13038 - RNA, 19 nt, artificial
  Chemically synthesized
uguagaagaugccucuuga

SEQ ID NO: 13039 - RNA, 19 nt, artificial
  Chemically synthesized
aggaugcaagauauauucc

SEQ ID NO: 13040 - RNA, 19 nt, artificial
  Chemically synthesized
uaggcucccucagugaugg

SEQ ID NO: 13041 - RNA, 19 nt, artificial
  Chemically synthesized
auauaugugugugucugua

SEQ ID NO: 13042 - RNA, 19 nt, artificial
  Chemically synthesized
cagcgcuuccucuuucucc

SEQ ID NO: 13043 - RNA, 19 nt, artificial
  Chemically synthesized
auuauaaacucaggaugca

SEQ ID NO: 13044 - RNA, 19 nt, artificial
  Chemically synthesized
gacccauuaggaaauaagg

SEQ ID NO: 13045 - RNA, 19 nt, artificial
  Chemically synthesized
agcugcucaggcgagucuc

SEQ ID NO: 13046 - RNA, 19 nt, artificial
  Chemically synthesized
ugugaaagaugcagaugag

SEQ ID NO: 13047 - RNA, 19 nt, artificial
  Chemically synthesized
ugcccaauuuuuguucagg

SEQ ID NO: 13048 - RNA, 19 nt, artificial
  Chemically synthesized
cugugucugcaguucauug

SEQ ID NO: 13049 - RNA, 19 nt, artificial
  Chemically synthesized
ugaguagggacacaagaga

SEQ ID NO: 13050 - RNA, 19 nt, artificial
  Chemically synthesized
aagcugggaggugugaaag

SEQ ID NO: 13051 - RNA, 19 nt, artificial
  Chemically synthesized
acuguggaagaagcugccc

SEQ ID NO: 13052 - RNA, 19 nt, artificial
  Chemically synthesized
agaguuugguuucaaugag

SEQ ID NO: 13053 - RNA, 19 nt, artificial
  Chemically synthesized
aggguaaaguauaaauugc

SEQ ID NO: 13054 - RNA, 19 nt, artificial
  Chemically synthesized
acuagcaauagaccagaca

SEQ ID NO: 13055 - RNA, 19 nt, artificial
  Chemically synthesized
ugugugucuguaugugagu

SEQ ID NO: 13056 - RNA, 19 nt, artificial
  Chemically synthesized
aaagaugcagaugagaggu

SEQ ID NO: 13057 - RNA, 19 nt, artificial
  Chemically synthesized
cagaaguacauggacaggc

SEQ ID NO: 13058 - RNA, 19 nt, artificial
  Chemically synthesized
cuucuuagucucagcuggu

SEQ ID NO: 13059 - RNA, 19 nt, artificial
  Chemically synthesized
augggcggugugcagaggc

SEQ ID NO: 13060 - RNA, 19 nt, artificial
  Chemically synthesized
uguccuggcugauaaucca

SEQ ID NO: 13061 - RNA, 19 nt, artificial
  Chemically synthesized
cccauuaggaaauaaggcu

SEQ ID NO: 13062 - RNA, 19 nt, artificial
  Chemically synthesized
caggaugcaagauauauuc

SEQ ID NO: 13063 - RNA, 19 nt, artificial
  Chemically synthesized
acagcugugucugcaguuc

SEQ ID NO: 13064 - RNA, 19 nt, artificial
  Chemically synthesized
uuuaagcagcucucuuccu

SEQ ID NO: 13065 - RNA, 19 nt, artificial
  Chemically synthesized
uacaacgaaaggaggaggc

SEQ ID NO: 13066 - RNA, 19 nt, artificial
  Chemically synthesized
guaaaggcuucucagccuc

SEQ ID NO: 13067 - RNA, 19 nt, artificial
  Chemically synthesized
aggauauaggaagaauggc

SEQ ID NO: 13068 - RNA, 19 nt, artificial
  Chemically synthesized
aucggcuuuucucagauau

SEQ ID NO: 13069 - RNA, 19 nt, artificial
  Chemically synthesized
aaugaaaagcagcccaagc

SEQ ID NO: 13070 - RNA, 19 nt, artificial
  Chemically synthesized
gagguauaaauacugguac

SEQ ID NO: 13071 - RNA, 19 nt, artificial
  Chemically synthesized
cgcacguucaagaacagag

SEQ ID NO: 13072 - RNA, 19 nt, artificial
  Chemically synthesized
aauuuuuguucagggacau

SEQ ID NO: 13073 - RNA, 19 nt, artificial
  Chemically synthesized
ugguccuguucuauagugu

SEQ ID NO: 13074 - RNA, 19 nt, artificial
  Chemically synthesized
aaugugauguccagcugcu

SEQ ID NO: 13075 - RNA, 19 nt, artificial
  Chemically synthesized
cuccaguugccggaucucc

SEQ ID NO: 13076 - RNA, 19 nt, artificial
  Chemically synthesized
aauccagcaaguggacaug

SEQ ID NO: 13077 - RNA, 19 nt, artificial
  Chemically synthesized
cucugugcuucauuagagg

SEQ ID NO: 13078 - RNA, 19 nt, artificial
  Chemically synthesized
cuucaagauauacuuuugg

SEQ ID NO: 13079 - RNA, 19 nt, artificial
  Chemically synthesized
uaagaaaagguaccuugcu

SEQ ID NO: 13080 - RNA, 19 nt, artificial
  Chemically synthesized
cacugaagcaucaguaggc

SEQ ID NO: 13081 - RNA, 19 nt, artificial
  Chemically synthesized
cguucaagaacagagacag

SEQ ID NO: 13082 - RNA, 19 nt, artificial
  Chemically synthesized
ggacccauuaggaaauaag

SEQ ID NO: 13083 - RNA, 19 nt, artificial
  Chemically synthesized
cucaagugaggaaacugag

SEQ ID NO: 13084 - RNA, 19 nt, artificial
  Chemically synthesized
augugugaauggcucagag

SEQ ID NO: 13085 - RNA, 19 nt, artificial
  Chemically synthesized
agaaccaagauuuggugca

SEQ ID NO: 13086 - RNA, 19 nt, artificial
  Chemically synthesized
acagggauucaaacacagc

SEQ ID NO: 13087 - RNA, 19 nt, artificial
  Chemically synthesized
ugugaauggcucagagcug

SEQ ID NO: 13088 - RNA, 19 nt, artificial
  Chemically synthesized
aaggaggaaguggaauggg

SEQ ID NO: 13089 - RNA, 19 nt, artificial
  Chemically synthesized
aguccagcaacagccagcu

SEQ ID NO: 13090 - RNA, 19 nt, artificial
  Chemically synthesized
agcaugaccacaggcaucc

SEQ ID NO: 13091 - RNA, 19 nt, artificial
  Chemically synthesized
agacgugucugugaaguug

SEQ ID NO: 13092 - RNA, 19 nt, artificial
  Chemically synthesized
ccaggaucccuucucaugc

SEQ ID NO: 13093 - RNA, 19 nt, artificial
  Chemically synthesized
cugugaaguuggcaucucc

SEQ ID NO: 13094 - RNA, 19 nt, artificial
  Chemically synthesized
gcuugugucuccaguugcc

SEQ ID NO: 13095 - RNA, 19 nt, artificial
  Chemically synthesized
gaucagucgcuucugaugg

SEQ ID NO: 13096 - RNA, 19 nt, artificial
  Chemically synthesized
uuuccuacagggauucaaa

SEQ ID NO: 13097 - RNA, 19 nt, artificial
  Chemically synthesized
auggcucagagcugagcug

SEQ ID NO: 13098 - RNA, 19 nt, artificial
  Chemically synthesized
cuucucagccuccuccugc

SEQ ID NO: 13099 - RNA, 19 nt, artificial
  Chemically synthesized
cagcuacucucuguucucc

SEQ ID NO: 13100 - RNA, 19 nt, artificial
  Chemically synthesized
ucgcuguuuguaaacaaau

SEQ ID NO: 13101 - RNA, 19 nt, artificial
  Chemically synthesized
ugguuaggcucccucagug

SEQ ID NO: 13102 - RNA, 19 nt, artificial
  Chemically synthesized
uaguuugucuguuccaguu

SEQ ID NO: 13103 - RNA, 19 nt, artificial
  Chemically synthesized
ucuggaagucacauuccuu

SEQ ID NO: 13104 - RNA, 19 nt, artificial
  Chemically synthesized
cugcccuacaaucuggagc

SEQ ID NO: 13105 - RNA, 19 nt, artificial
  Chemically synthesized
ccuguaaaggcuucucagc

SEQ ID NO: 13106 - RNA, 19 nt, artificial
  Chemically synthesized
ugucuguaugugagucugu

SEQ ID NO: 13107 - RNA, 19 nt, artificial
  Chemically synthesized
ugucugccagcgcuuccuc

SEQ ID NO: 13108 - RNA, 19 nt, Artificial Sequence
  Chemically synthesized
ugaguuuaagcagcucucu

SEQ ID NO: 13109 - RNA, 19 nt, artificial
  Chemically synthesized
agcguuucgaugccuucau

SEQ ID NO: 13110 - RNA, 19 nt, artificial
  Chemically synthesized
cuccaggugcccaucagaa

SEQ ID NO: 13111 - RNA, 19 nt, artificial
  Chemically synthesized
ggcugcuggacgccuggca

SEQ ID NO: 13112 - RNA, 19 nt, artificial
  Chemically synthesized
gccgcuguagacagcagug

SEQ ID NO: 13113 - RNA, 19 nt, artificial
  Chemically synthesized
caaguacaaggcaaugaag

SEQ ID NO: 13114 - RNA, 19 nt, artificial
  Chemically synthesized
acuuggagauccggcaacu

SEQ ID NO: 13115 - RNA, 19 nt, artificial
  Chemically synthesized
ccaguuugugcaggagaug

SEQ ID NO: 13116 - RNA, 19 nt, artificial
  Chemically synthesized
ccgcuguagacagcagugu

SEQ ID NO: 13117 - RNA, 19 nt, artificial
  Chemically synthesized
gagcaaggaaugugacuuc

SEQ ID NO: 13118 - RNA, 19 nt, artificial
  Chemically synthesized
cauccugagguucaucacu

SEQ ID NO: 13119 - RNA, 19 nt, artificial
  Chemically synthesized
cugagcguuucgaugccuu

SEQ ID NO: 13120 - RNA, 19 nt, artificial
  Chemically synthesized
aaguacaaggcaaugaaga

SEQ ID NO: 13121 - RNA, 19 nt, artificial
  Chemically synthesized
uccugagguucaucacugu

SEQ ID NO: 13122 - RNA, 19 nt, artificial
  Chemically synthesized
caaggaaugugacuuccag

SEQ ID NO: 13123 - RNA, 19 nt, artificial
  Chemically synthesized
acauccaguuugugcagga

SEQ ID NO: 13124 - RNA, 19 nt, artificial
  Chemically synthesized
ggaggagauggacuuugag

SEQ ID NO: 13125 - RNA, 19 nt, artificial
  Chemically synthesized
cagugucccacggacagca

SEQ ID NO: 13126 - RNA, 19 nt, artificial
  Chemically synthesized
caacuggaacagacaaacu

SEQ ID NO: 13127 - RNA, 19 nt, artificial
  Chemically synthesized
gccgccggauggugguggu

SEQ ID NO: 13128 - RNA, 19 nt, artificial
  Chemically synthesized
gaugguggugguugucucu

SEQ ID NO: 13129 - RNA, 19 nt, artificial
  Chemically synthesized
ccugcaccaaaucuugguu

SEQ ID NO: 13130 - RNA, 19 nt, artificial
  Chemically synthesized
cuuugaguacuuggagauc

SEQ ID NO: 13131 - RNA, 19 nt, artificial
  Chemically synthesized
gauugccaaaaguauaucu

SEQ ID NO: 13132 - RNA, 19 nt, artificial
  Chemically synthesized
gagaagccuuuacaggugg

SEQ ID NO: 13133 - RNA, 19 nt, artificial
  Chemically synthesized
ugauccggcaacuggaaca

SEQ ID NO: 13134 - RNA, 19 nt, artificial
  Chemically synthesized
auccaguuugugcaggaga

SEQ ID NO: 13135 - RNA, 19 nt, artificial
  Chemically synthesized
cuggcggaggagauggacu

SEQ ID NO: 13136 - RNA, 19 nt, artificial
  Chemically synthesized
ccuggcugcucucaacaug

SEQ ID NO: 13137 - RNA, 19 nt, artificial
  Chemically synthesized
agcauccugagguucauca

SEQ ID NO: 13138 - RNA, 19 nt, artificial
  Chemically synthesized
cccugcaccaaaucuuggu

SEQ ID NO: 13139 - RNA, 19 nt, artificial
  Chemically synthesized
auaucuugaagcagcagca

SEQ ID NO: 13140 - RNA, 19 nt, artificial
  Chemically synthesized
gacugaaguuguguguguc

SEQ ID NO: 13141 - RNA, 19 nt, artificial
  Chemically synthesized
cugagguucaucacugucu

SEQ ID NO: 13142 - RNA, 19 nt, artificial
  Chemically synthesized
ugcaggagaugauccggca

SEQ ID NO: 13143 - RNA, 19 nt, artificial
  Chemically synthesized
cccaucagaagcgacugau

SEQ ID NO: 13144 - RNA, 19 nt, artificial
  Chemically synthesized
cucucaacaugcgagugcg

SEQ ID NO: 13145 - RNA, 19 nt, artificial
  Chemically synthesized
ccugcagagcaaggaaugu

SEQ ID NO: 13146 - RNA, 19 nt, artificial
  Chemically synthesized
uccagaccaaauuugcacu

SEQ ID NO: 13147 - RNA, 19 nt, artificial
  Chemically synthesized
caaauuugcacucagccuc

SEQ ID NO: 13148 - RNA, 19 nt, artificial
  Chemically synthesized
aacuaucgacugaaguugu

SEQ ID NO: 13149 - RNA, 19 nt, artificial
  Chemically synthesized
gcuguagacagcagugucc

SEQ ID NO: 13150 - RNA, 19 nt, artificial
  Chemically synthesized
cgagcugcuuaccaagcug

SEQ ID NO: 13151 - RNA, 19 nt, artificial
  Chemically synthesized
cagagcaaggaaugugacu

SEQ ID NO: 13152 - RNA, 19 nt, artificial
  Chemically synthesized
ggaaugugacuuccagacc

SEQ ID NO: 13153 - RNA, 19 nt, artificial
  Chemically synthesized
cuggaacagacaaacuauc

SEQ ID NO: 13154 - RNA, 19 nt, artificial
  Chemically synthesized
cugcucucaacaugcgagu

SEQ ID NO: 13155 - RNA, 19 nt, artificial
  Chemically synthesized
caaugaagaaagaguuccc

SEQ ID NO: 13156 - RNA, 19 nt, artificial
  Chemically synthesized
gcggaggagauggacuuug

SEQ ID NO: 13157 - RNA, 19 nt, artificial
  Chemically synthesized
cccagcgacauccaguuug

SEQ ID NO: 13158 - RNA, 19 nt, artificial
  Chemically synthesized
gcguuucgaugccuucauc

SEQ ID NO: 13159 - RNA, 19 nt, artificial
  Chemically synthesized
ggacacagguggcggccga

SEQ ID NO: 13160 - RNA, 19 nt, artificial
  Chemically synthesized
ggagaugauccggcaacug

SEQ ID NO: 13161 - RNA, 19 nt, artificial
  Chemically synthesized
aaauuugcacucagccucu

SEQ ID NO: 13162 - RNA, 19 nt, artificial
  Chemically synthesized
gcaacuggaacagacaaac

SEQ ID NO: 13163 - RNA, 19 nt, artificial
  Chemically synthesized
aaaucuugguucuggacuc

SEQ ID NO: 13164 - RNA, 19 nt, artificial
  Chemically synthesized
gcauaugccugagcguuuc

SEQ ID NO: 13165 - RNA, 19 nt, artificial
  Chemically synthesized
agauccggcaacuggagac

SEQ ID NO: 13166 - RNA, 19 nt, artificial
  Chemically synthesized
gaacagacaaacuaucgac

SEQ ID NO: 13167 - RNA, 19 nt, artificial
  Chemically synthesized
gcuggcgggcaucaccaca

SEQ ID NO: 13168 - RNA, 19 nt, artificial
  Chemically synthesized
cgaugccuucaucugcuau

SEQ ID NO: 13169 - RNA, 19 nt, artificial
  Chemically synthesized
ccacuggcaggcugcugga

SEQ ID NO: 13170 - RNA, 19 nt, artificial
  Chemically synthesized
cuguucuugaacgugcgga

SEQ ID NO: 13171 - RNA, 19 nt, artificial
  Chemically synthesized
gacagcagugucccacgga

SEQ ID NO: 13172 - RNA, 19 nt, artificial
  Chemically synthesized
cguuucgaugccuucaucu

SEQ ID NO: 13173 - RNA, 19 nt, artificial
  Chemically synthesized
gugucccacggacagcaga

SEQ ID NO: 13174 - RNA, 19 nt, artificial
  Chemically synthesized
agcugggacccagcauuga

SEQ ID NO: 13175 - RNA, 19 nt, artificial
  Chemically synthesized
uaccugcagagcaaggaau

SEQ ID NO: 13176 - RNA, 19 nt, artificial
  Chemically synthesized
ugcacucagccucucucca

SEQ ID NO: 13177 - RNA, 19 nt, artificial
  Chemically synthesized
ucgaugccuucaucugcua

SEQ ID NO: 13178 - RNA, 19 nt, artificial
  Chemically synthesized
cgacauccaguuugugcag

SEQ ID NO: 13179 - RNA, 19 nt, artificial
  Chemically synthesized
gagauccggcaacuggaga

SEQ ID NO: 13180 - RNA, 19 nt, artificial
  Chemically synthesized
gcugcucucaacaugcgag

SEQ ID NO: 13181 - RNA, 19 nt, artificial
  Chemically synthesized
ggugccgccggaugguggu

SEQ ID NO: 13182 - RNA, 19 nt, artificial
  Chemically synthesized
gccgcgacgacgugcugcu

SEQ ID NO: 13183 - RNA, 19 nt, artificial
  Chemically synthesized
gcauccugagguucaucac

SEQ ID NO: 13184 - RNA, 19 nt, artificial
  Chemically synthesized
ggauugccaaaaguauauc

SEQ ID NO: 13185 - RNA, 19 nt, artificial
  Chemically synthesized
ucuggacucgccuugccaa

SEQ ID NO: 13186 - RNA, 19 nt, artificial
  Chemically synthesized
gcuggacgccuggcaggga

SEQ ID NO: 13187 - RNA, 19 nt, artificial
  Chemically synthesized
uugaguacuuggagauccg

SEQ ID NO: 13188 - RNA, 19 nt, artificial
  Chemically synthesized
guuugugcaggagaugauc

SEQ ID NO: 13189 - RNA, 19 nt, artificial
  Chemically synthesized
uguucuugaacgugcggac

SEQ ID NO: 13190 - RNA, 19 nt, artificial
  Chemically synthesized
ucuugaagcagcagcagga

SEQ ID NO: 13191 - RNA, 19 nt, artificial
  Chemically synthesized
aucaaguacaaggcaauga

SEQ ID NO: 13192 - RNA, 19 nt, artificial
  Chemically synthesized
acgacgugcugcuggagcu

SEQ ID NO: 13193 - RNA, 19 nt, artificial
  Chemically synthesized
gcaccaaaucuugguucug

SEQ ID NO: 13194 - RNA, 19 nt, artificial
  Chemically synthesized
ccggucuccuccacauccu

SEQ ID NO: 13195 - RNA, 19 nt, artificial
  Chemically synthesized
cuaucgacugaaguugugu

SEQ ID NO: 13196 - RNA, 19 nt, artificial
  Chemically synthesized
gaaaagaggugccgccgga

SEQ ID NO: 13197 - RNA, 19 nt, artificial
  Chemically synthesized
cucugaugauuaccugcag

SEQ ID NO: 13198 - RNA, 19 nt, artificial
  Chemically synthesized
gcaaugaagaaagaguucc

SEQ ID NO: 13199 - RNA, 19 nt, artificial
  Chemically synthesized
ugagguucaucacugucug

SEQ ID NO: 13200 - RNA, 19 nt, artificial
  Chemically synthesized
ucugaugauuaccugcaga

SEQ ID NO: 13201 - RNA, 19 nt, artificial
  Chemically synthesized
acuuccagaccaaauuugc

SEQ ID NO: 13202 - RNA, 19 nt, artificial
  Chemically synthesized
ccucucuccaggugcccau

SEQ ID NO: 13203 - RNA, 19 nt, artificial
  Chemically synthesized
gccucucuccaggugccca

SEQ ID NO: 13204 - RNA, 19 nt, artificial
  Chemically synthesized
aggaaugugacuuccagac

SEQ ID NO: 13205 - RNA, 19 nt, artificial
  Chemically synthesized
uuaccugcagagcaaggaa

SEQ ID NO: 13206 - RNA, 19 nt, artificial
  Chemically synthesized
gaacgugcggacacaggug

SEQ ID NO: 13207 - RNA, 19 nt, artificial
  Chemically synthesized
gcagagcaaggaaugugac

SEQ ID NO: 13208 - RNA, 19 nt, artificial
  Chemically synthesized
uacaaggcaaugaagaaag

SEQ ID NO: 13209 - RNA, 19 nt, artificial
  Chemically synthesized
cugccuggcaccugugucu

SEQ ID NO: 13210 - RNA, 19 nt, artificial
  Chemically synthesized
agcagcaggaggaggcuga

SEQ ID NO: 13211 - RNA, 19 nt, artificial
  Chemically synthesized
cucgccuugccaaggccuu

SEQ ID NO: 13212 - RNA, 19 nt, artificial
  Chemically synthesized
guucaucacugucugcgac

SEQ ID NO: 13213 - RNA, 19 nt, artificial
  Chemically synthesized
gcacucagccucucuccag

SEQ ID NO: 13214 - RNA, 19 nt, artificial
  Chemically synthesized
gcaggcugcuggacgccug

SEQ ID NO: 13215 - RNA, 19 nt, artificial
  Chemically synthesized
uguccugccuggcaccugu

SEQ ID NO: 13216 - RNA, 19 nt, artificial
  Chemically synthesized
caaaaguauaucuugaagc

SEQ ID NO: 13217 - RNA, 19 nt, artificial
  Chemically synthesized
cagguggccgcuguagaca

SEQ ID NO: 13218 - RNA, 19 nt, artificial
  Chemically synthesized
cuuuacagguggccgcugu

SEQ ID NO: 13219 - RNA, 19 nt, artificial
  Chemically synthesized
acugaaguugugugugucu

SEQ ID NO: 13220 - RNA, 19 nt, artificial
  Chemically synthesized
ggccuugucccugcccuga

SEQ ID NO: 13221 - RNA, 19 nt, artificial
  Chemically synthesized
cacucagccucucuccagg

SEQ ID NO: 13222 - RNA, 19 nt, artificial
  Chemically synthesized
aggugcccaucagaagcga

SEQ ID NO: 13223 - RNA, 19 nt, artificial
  Chemically synthesized
aaguauaucuugaagcagc

SEQ ID NO: 13224 - RNA, 19 nt, artificial
  Chemically synthesized
gucucuguucuugaacgug

SEQ ID NO: 13225 - RNA, 19 nt, artificial
  Chemically synthesized
caaaucuugguucuggacu

SEQ ID NO: 13226 - RNA, 19 nt, artificial
  Chemically synthesized
augccuucaucugcuauug

SEQ ID NO: 13227 - RNA, 19 nt, artificial
  Chemically synthesized
ccaaaucuugguucuggac

SEQ ID NO: 13228 - RNA, 19 nt, artificial
  Chemically synthesized
aguugugugugucugaccg

SEQ ID NO: 13229 - RNA, 19 nt, artificial
  Chemically synthesized
gagcugggacccagcauug

SEQ ID NO: 13230 - RNA, 19 nt, artificial
  Chemically synthesized
caccaaaucuugguucugg

SEQ ID NO: 13231 - RNA, 19 nt, artificial
  Chemically synthesized
ccaagcugggccgcgacga

SEQ ID NO: 13232 - RNA, 19 nt, artificial
  Chemically synthesized
agcugggccgcgacgacgu

SEQ ID NO: 13233 - RNA, 19 nt, artificial
  Chemically synthesized
guuucgaugccuucaucug

SEQ ID NO: 13234 - RNA, 19 nt, artificial
  Chemically synthesized
ccgccggaugguggugguu

SEQ ID NO: 13235 - RNA, 19 nt, artificial
  Chemically synthesized
cuggcugcucucaacaugc

SEQ ID NO: 13236 - RNA, 19 nt, artificial
  Chemically synthesized
accugcagagcaaggaaug

SEQ ID NO: 13237 - RNA, 19 nt, artificial
  Chemically synthesized
cggaugguggugguugucu

SEQ ID NO: 13238 - RNA, 19 nt, artificial
  Chemically synthesized
caggagaugauccggcaac

SEQ ID NO: 13239 - RNA, 19 nt, artificial
  Chemically synthesized
caucaaguacaaggcaaug

SEQ ID NO: 13240 - RNA, 19 nt, artificial
  Chemically synthesized
agguggccgcuguagacag

SEQ ID NO: 13241 - RNA, 19 nt, artificial
  Chemically synthesized
ccagaccaaauuugcacuc

SEQ ID NO: 13242 - RNA, 19 nt, artificial
  Chemically synthesized
gcgggcaucaccacacuug

SEQ ID NO: 13243 - RNA, 19 nt, artificial
  Chemically synthesized
gugcccaucagaagcgacu

SEQ ID NO: 13244 - RNA, 19 nt, artificial
  Chemically synthesized
gguggccgcuguagacagc

SEQ ID NO: 13245 - RNA, 19 nt, artificial
  Chemically synthesized
gccuucaucugcuauugcc

SEQ ID NO: 13246 - RNA, 19 nt, artificial
  Chemically synthesized
ugaacgugcggacacaggu

SEQ ID NO: 13247 - RNA, 19 nt, artificial
  Chemically synthesized
cagcaggaggaggcugaga

SEQ ID NO: 13248 - RNA, 19 nt, artificial
  Chemically synthesized
ggugcccaucagaagcgac

SEQ ID NO: 13249 - RNA, 19 nt, artificial
  Chemically synthesized
gaguacuuggagauccggc

SEQ ID NO: 13250 - RNA, 19 nt, artificial
  Chemically synthesized
guggugguugucucugaug

SEQ ID NO: 13251 - RNA, 19 nt, artificial
  Chemically synthesized
aacagacaaacuaucgacu

SEQ ID NO: 13252 - RNA, 19 nt, artificial
  Chemically synthesized
cuggcaggcugcuggacgc

SEQ ID NO: 13253 - RNA, 19 nt, artificial
  Chemically synthesized
uggcgggcaucaccacacu

SEQ ID NO: 13254 - RNA, 19 nt, artificial
  Chemically synthesized
gguucuggacucgccuugc

SEQ ID NO: 13255 - RNA, 19 nt, artificial
  Chemically synthesized
cgugcugcuggagcuggga

SEQ ID NO: 13256 - RNA, 19 nt, artificial
  Chemically synthesized
ggcaggcugcuggacgccu

SEQ ID NO: 13257 - RNA, 19 nt, artificial
  Chemically synthesized
cuugucccugcccugaaga

SEQ ID NO: 13258 - RNA, 19 nt, artificial
  Chemically synthesized
ccuggcaccugugucuggu

SEQ ID NO: 13259 - RNA, 19 nt, artificial
  Chemically synthesized
cuugguucuggacucgccu

SEQ ID NO: 13260 - RNA, 19 nt, artificial
  Chemically synthesized
gccaaggccuugucccugc

SEQ ID NO: 13261 - RNA, 19 nt, artificial
  Chemically synthesized
gcugggacccagcauugag

SEQ ID NO: 13262 - RNA, 19 nt, artificial
  Chemically synthesized
guggccgcuguagacagca

SEQ ID NO: 13263 - RNA, 19 nt, artificial
  Chemically synthesized
gaaguugugugugucugac

SEQ ID NO: 13264 - RNA, 19 nt, artificial
  Chemically synthesized
cgccuugccaaggccuugu

SEQ ID NO: 13265 - RNA, 19 nt, artificial
  Chemically synthesized
cuugaacgugcggacacag

SEQ ID NO: 13266 - RNA, 19 nt, artificial
  Chemically synthesized
auuugcacucagccucucu

SEQ ID NO: 13267 - RNA, 19 nt, artificial
  Chemically synthesized
ugaagcagcagcaggagga

SEQ ID NO: 13268 - RNA, 19 nt, artificial
  Chemically synthesized
cuuggagauccggcaacug

SEQ ID NO: 13269 - RNA, 19 nt, artificial
  Chemically synthesized
gucucugaugauuaccugc

SEQ ID NO: 13270 - RNA, 19 nt, artificial
  Chemically synthesized
cugaaguugugugugucug

SEQ ID NO: 13271 - RNA, 19 nt, artificial
  Chemically synthesized
auccugagguucaucacug

SEQ ID NO: 13272 - RNA, 19 nt, artificial
  Chemically synthesized
uccuccacauccucccuuc

SEQ ID NO: 13273 - RNA, 19 nt, artificial
  Chemically synthesized
agcaaggaaugugacuucc

SEQ ID NO: 13274 - RNA, 19 nt, artificial
  Chemically synthesized
gagaugauccggcaacugg

SEQ ID NO: 13275 - RNA, 19 nt, artificial
  Chemically synthesized
caaggcaaugaagaaagag

SEQ ID NO: 13276 - RNA, 19 nt, artificial
  Chemically synthesized
cauccaguuugugcaggag

SEQ ID NO: 13277 - RNA, 19 nt, artificial
  Chemically synthesized
ccugagcguuucgaugccu

SEQ ID NO: 13278 - RNA, 19 nt, artificial
  Chemically synthesized
cgccggaugguggugguug

SEQ ID NO: 13279 - RNA, 19 nt, artificial
  Chemically synthesized
gauuaccugcagagcaagg

SEQ ID NO: 13280 - RNA, 19 nt, artificial
  Chemically synthesized
ucucugaugauuaccugca

SEQ ID NO: 13281 - RNA, 19 nt, artificial
  Chemically synthesized
aggaggaggcugagaagcc

SEQ ID NO: 13282 - RNA, 19 nt, artificial
  Chemically synthesized
cugcagagcaaggaaugug

SEQ ID NO: 13283 - RNA, 19 nt, artificial
  Chemically synthesized
acaaacuaucgacugaagu

SEQ ID NO: 13284 - RNA, 19 nt, artificial
  Chemically synthesized
uggcaccugugucuggucu

SEQ ID NO: 13285 - RNA, 19 nt, artificial
  Chemically synthesized
cagccucucuccaggugcc

SEQ ID NO: 13286 - RNA, 19 nt, artificial
  Chemically synthesized
cuggagcugggacccagca

SEQ ID NO: 13287 - RNA, 19 nt, artificial
  Chemically synthesized
acuaucgacugaaguugug

SEQ ID NO: 13288 - RNA, 19 nt, artificial
  Chemically synthesized
uugccaaaaguauaucuug

SEQ ID NO: 13289 - RNA, 19 nt, artificial
  Chemically synthesized
ccaggugcccaucagaagc

SEQ ID NO: 13290 - RNA, 19 nt, artificial
  Chemically synthesized
cuggacgccuggcagggac

SEQ ID NO: 13291 - RNA, 19 nt, artificial
  Chemically synthesized
agcagugucccacggacag

SEQ ID NO: 13292 - RNA, 19 nt, artificial
  Chemically synthesized
gagguucaucacugucugc

SEQ ID NO: 13293 - RNA, 19 nt, artificial
  Chemically synthesized
gccuuuacagguggccgcu

SEQ ID NO: 13294 - RNA, 19 nt, artificial
  Chemically synthesized
cagcgacauccaguuugug

SEQ ID NO: 13295 - RNA, 19 nt, artificial
  Chemically synthesized
ugauuaccugcagagcaag

SEQ ID NO: 13296 - RNA, 19 nt, artificial
  Chemically synthesized
cuccuccacauccucccuu

SEQ ID NO: 13297 - RNA, 19 nt, artificial
  Chemically synthesized
aucgacugaaguugugugu

SEQ ID NO: 13298 - RNA, 19 nt, artificial
  Chemically synthesized
ccggaugguggugguuguc

SEQ ID NO: 13299 - RNA, 19 nt, artificial
  Chemically synthesized
cugaugauuaccugcagag

SEQ ID NO: 13300 - RNA, 19 nt, artificial
  Chemically synthesized
ccuccacauccucccuucc

SEQ ID NO: 13301 - RNA, 19 nt, artificial
  Chemically synthesized
gcugcuggacgccuggcag

SEQ ID NO: 13302 - RNA, 19 nt, artificial
  Chemically synthesized
cagcauccugagguucauc

SEQ ID NO: 13303 - RNA, 19 nt, artificial
  Chemically synthesized
gcgcuggcggaggagaugg

SEQ ID NO: 13304 - RNA, 19 nt, artificial
  Chemically synthesized
uuugaguacuuggagaucc

SEQ ID NO: 13305 - RNA, 19 nt, artificial
  Chemically synthesized
gagcugcuuaccaagcugg

SEQ ID NO: 13306 - RNA, 19 nt, artificial
  Chemically synthesized
cuggcaccugugucugguc

SEQ ID NO: 13307 - RNA, 19 nt, artificial
  Chemically synthesized
gccugagcguuucgaugcc

SEQ ID NO: 13308 - RNA, 19 nt, artificial
  Chemically synthesized
uacagguggccgcuguaga

SEQ ID NO: 13309 - RNA, 19 nt, artificial
  Chemically synthesized
ucuccaggugcccaucaga

SEQ ID NO: 13310 - RNA, 19 nt, artificial
  Chemically synthesized
ggacucgccuugccaaggc

SEQ ID NO: 13311 - RNA, 19 nt, artificial
  Chemically synthesized
uugguucuggacucgccuu

SEQ ID NO: 13312 - RNA, 19 nt, artificial
  Chemically synthesized
auggacuuugaguacuugg

SEQ ID NO: 13313 - RNA, 19 nt, artificial
  Chemically synthesized
gccuggcaccugugucugg

SEQ ID NO: 13314 - RNA, 19 nt, artificial
  Chemically synthesized
uagacagcagugucccacg

SEQ ID NO: 13315 - RNA, 19 nt, artificial
  Chemically synthesized
uggaacagacaaacuaucg

SEQ ID NO: 13316 - RNA, 19 nt, artificial
  Chemically synthesized
acagcagugucccacggac

SEQ ID NO: 13317 - RNA, 19 nt, artificial
  Chemically synthesized
agcgacauccaguuugugc

SEQ ID NO: 13318 - RNA, 19 nt, artificial
  Chemically synthesized
uggcugcucucaacaugcg

SEQ ID NO: 13319 - RNA, 19 nt, artificial
  Chemically synthesized
aaacuaucgacugaaguug

SEQ ID NO: 13320 - RNA, 19 nt, artificial
  Chemically synthesized
agaagccuuuacagguggc

SEQ ID NO: 13321 - RNA, 19 nt, artificial
  Chemically synthesized
cucuccaggugcccaucag

SEQ ID NO: 13322 - RNA, 19 nt, artificial
  Chemically synthesized
caucagaagcgacugaucc

SEQ ID NO: 13323 - RNA, 19 nt, artificial
  Chemically synthesized
ccugagguucaucacuguc

SEQ ID NO: 13324 - RNA, 19 nt, artificial
  Chemically synthesized
ugcucucaacaugcgagug

SEQ ID NO: 13325 - RNA, 19 nt, artificial
  Chemically synthesized
acagacaaacuaucgacug

SEQ ID NO: 13326 - RNA, 19 nt, artificial
  Chemically synthesized
gcuggcggaggagauggac

SEQ ID NO: 13327 - RNA, 19 nt, artificial
  Chemically synthesized
uggagcugggacccagcau

SEQ ID NO: 13328 - RNA, 19 nt, artificial
  Chemically synthesized
acucagccucucuccaggu

SEQ ID NO: 13329 - RNA, 19 nt, artificial
  Chemically synthesized
cugcaccaaaucuugguuc

SEQ ID NO: 13330 - RNA, 19 nt, artificial
  Chemically synthesized
acagguggccgcuguagac

SEQ ID NO: 13331 - RNA, 19 nt, artificial
  Chemically synthesized
gggacccagcauugaggag

SEQ ID NO: 13332 - RNA, 19 nt, artificial
  Chemically synthesized
ucucuguucuugaacgugc

SEQ ID NO: 13333 - RNA, 19 nt, artificial
  Chemically synthesized
ugagcguuucgaugccuuc

SEQ ID NO: 13334 - RNA, 19 nt, artificial
  Chemically synthesized
ugucucugaugauuaccug

SEQ ID NO: 13335 - RNA, 19 nt, artificial
  Chemically synthesized
guagacagcagugucccac

SEQ ID NO: 13336 - RNA, 19 nt, artificial
  Chemically synthesized
ccuucaucugcuauugccc

SEQ ID NO: 13337 - RNA, 19 nt, artificial
  Chemically synthesized
cuggacucgccuugccaag

SEQ ID NO: 13338 - RNA, 19 nt, artificial
  Chemically synthesized
gcuggagcugggacccagc

SEQ ID NO: 13339 - RNA, 19 nt, artificial
  Chemically synthesized
uccggcaacuggaacagac

SEQ ID NO: 13340 - RNA, 19 nt, artificial
  Chemically synthesized
ugaguacuuggagauccgg

SEQ ID NO: 13341 - RNA, 19 nt, artificial
  Chemically synthesized
cugcuggagcugggaccca

SEQ ID NO: 13342 - RNA, 19 nt, artificial
  Chemically synthesized
uucgaugccuucaucugcu

SEQ ID NO: 13343 - RNA, 19 nt, artificial
  Chemically synthesized
ggucuccuccacauccucc

SEQ ID NO: 13344 - RNA, 19 nt, artificial
  Chemically synthesized
guauaucuugaagcagcag

SEQ ID NO: 13345 - RNA, 19 nt, artificial
  Chemically synthesized
ugggacccagcauugagga

SEQ ID NO: 13346 - RNA, 19 nt, artificial
  Chemically synthesized
agaggugccgccggauggu

SEQ ID NO: 13347 - RNA, 19 nt, artificial
  Chemically synthesized
uaugccugagcguuucgau

SEQ ID NO: 13348 - RNA, 19 nt, artificial
  Chemically synthesized
uuaccaagcugggccgcga

SEQ ID NO: 13349 - RNA, 19 nt, artificial
  Chemically synthesized
cuguagacagcaguguccc

SEQ ID NO: 13350 - RNA, 19 nt, artificial
  Chemically synthesized
gacauccaguuugugcagg

SEQ ID NO: 13351 - RNA, 19 nt, artificial
  Chemically synthesized
cgauguccugccuggcacc

SEQ ID NO: 13352 - RNA, 19 nt, artificial
  Chemically synthesized
gcagcagcaggaggaggcu

SEQ ID NO: 13353 - RNA, 19 nt, artificial
  Chemically synthesized
cucagccucucuccaggug

SEQ ID NO: 13354 - RNA, 19 nt, artificial
  Chemically synthesized
uuuacagguggccgcugua

SEQ ID NO: 13355 - RNA, 19 nt, artificial
  Chemically synthesized
agacagcagugucccacgg

SEQ ID NO: 13356 - RNA, 19 nt, artificial
  Chemically synthesized
cgacgacgugcugcuggag

SEQ ID NO: 13357 - RNA, 19 nt, artificial
  Chemically synthesized
gcucucaacaugcgagugc

SEQ ID NO: 13358 - RNA, 19 nt, artificial
  Chemically synthesized
gcagugucccacggacagc

SEQ ID NO: 13359 - RNA, 19 nt, artificial
  Chemically synthesized
ugcuggagcugggacccag

SEQ ID NO: 13360 - RNA, 19 nt, artificial
  Chemically synthesized
ccgcgacgacgugcugcug

SEQ ID NO: 13361 - RNA, 19 nt, artificial
  Chemically synthesized
auuaccugcagagcaagga

SEQ ID NO: 13362 - RNA, 19 nt, artificial
  Chemically synthesized
uacuuggagauccggcaac

SEQ ID NO: 13363 - RNA, 19 nt, artificial
  Chemically synthesized
agccuuuacagguggccgc

SEQ ID NO: 13364 - RNA, 19 nt, artificial
  Chemically synthesized
cugggacccagcauugagg

SEQ ID NO: 13365 - RNA, 19 nt, artificial
  Chemically synthesized
uccaggugcccaucagaag

SEQ ID NO: 13366 - RNA, 19 nt, artificial
  Chemically synthesized
auccggcaacuggaacaga

SEQ ID NO: 13367 - RNA, 19 nt, artificial
  Chemically synthesized
cugcuggacgccuggcagg

SEQ ID NO: 13368 - RNA, 19 nt, artificial
  Chemically synthesized
caggaggaggcugagaagc

SEQ ID NO: 13369 - RNA, 19 nt, artificial
  Chemically synthesized
cggucuccuccacauccuc

SEQ ID NO: 13370 - RNA, 19 nt, artificial
  Chemically synthesized
ugcccaucagaagcgacug

SEQ ID NO: 13371 - RNA, 19 nt, artificial
  Chemically synthesized
uggccgcuguagacagcag

SEQ ID NO: 13372 - RNA, 19 nt, artificial
  Chemically synthesized
ugguucuggacucgccuug

SEQ ID NO: 13373 - RNA, 19 nt, artificial
  Chemically synthesized
cccacuggcaggcugcugg

SEQ ID NO: 13374 - RNA, 19 nt, artificial
  Chemically synthesized
uaucgacugaaguugugug

SEQ ID NO: 13375 - RNA, 19 nt, artificial
  Chemically synthesized
guugugugugucugaccgc

SEQ ID NO: 13376 - RNA, 19 nt, artificial
  Chemically synthesized
accaaauuugcacucagcc

SEQ ID NO: 13377 - RNA, 19 nt, artificial
  Chemically synthesized
caagcugggccgcgacgac

SEQ ID NO: 13378 - RNA, 19 nt, artificial
  Chemically synthesized
aucagaagcgacugauccc

SEQ ID NO: 13379 - RNA, 19 nt, artificial
  Chemically synthesized
uugucucugaugauuaccu

SEQ ID NO: 13380 - RNA, 19 nt, artificial
  Chemically synthesized
gcucaucgaaaagaggugc

SEQ ID NO: 13381 - RNA, 19 nt, artificial
  Chemically synthesized
uuccagaccaaauuugcac

SEQ ID NO: 13382 - RNA, 19 nt, artificial
  Chemically synthesized
cuggcgggcaucaccacac

SEQ ID NO: 13383 - RNA, 19 nt, artificial
  Chemically synthesized
uggacgccuggcagggacg

SEQ ID NO: 13384 - RNA, 19 nt, artificial
  Chemically synthesized
guccugccuggcaccugug

SEQ ID NO: 13385 - RNA, 19 nt, artificial
  Chemically synthesized
aaaguauaucuugaagcag

SEQ ID NO: 13386 - RNA, 19 nt, artificial
  Chemically synthesized
aauuugcacucagccucuc

SEQ ID NO: 13387 - RNA, 19 nt, artificial
  Chemically synthesized
cagguggcggccgacugga

SEQ ID NO: 13388 - RNA, 19 nt, artificial
  Chemically synthesized
gccuugccaaggccuuguc

SEQ ID NO: 13389 - RNA, 19 nt, artificial
  Chemically synthesized
aaucuugguucuggacucg

SEQ ID NO: 13390 - RNA, 19 nt, artificial
  Chemically synthesized
ugggccgcgacgacgugcu

SEQ ID NO: 13391 - RNA, 19 nt, artificial
  Chemically synthesized
cgacgugcugcuggagcug

SEQ ID NO: 13392 - RNA, 19 nt, artificial
  Chemically synthesized
uucuugaacgugcggacac

SEQ ID NO: 13393 - RNA, 19 nt, artificial
  Chemically synthesized
gucuccuccacauccuccc

SEQ ID NO: 13394 - RNA, 19 nt, artificial
  Chemically synthesized
cucucuccaggugcccauc

SEQ ID NO: 13395 - RNA, 19 nt, artificial
  Chemically synthesized
caggugcccaucagaagcg

SEQ ID NO: 13396 - RNA, 19 nt, artificial
  Chemically synthesized
ugccugagcguuucgaugc

SEQ ID NO: 13397 - RNA, 19 nt, artificial
  Chemically synthesized
aggccuugucccugcccug

SEQ ID NO: 13398 - RNA, 19 nt, artificial
  Chemically synthesized
augccugagcguuucgaug

SEQ ID NO: 13399 - RNA, 19 nt, artificial
  Chemically synthesized
gcagcaggaggaggcugag

SEQ ID NO: 13400 - RNA, 19 nt, artificial
  Chemically synthesized
uugccaaggccuugucccu

SEQ ID NO: 13401 - RNA, 19 nt, artificial
  Chemically synthesized
cgcgacgacgugcugcugg

SEQ ID NO: 13402 - RNA, 19 nt, artificial
  Chemically synthesized
ucuugguucuggacucgcc

SEQ ID NO: 13403 - RNA, 19 nt, artificial
  Chemically synthesized
ugaugauuaccugcagagc

SEQ ID NO: 13404 - RNA, 19 nt, artificial
  Chemically synthesized
gcugcuuaccaagcugggc

SEQ ID NO: 13405 - RNA, 19 nt, artificial
  Chemically synthesized
agcugcuuaccaagcuggg

SEQ ID NO: 13406 - RNA, 19 nt, artificial
  Chemically synthesized
ugucccacggacagcagag

SEQ ID NO: 13407 - RNA, 19 nt, artificial
  Chemically synthesized
ucuccuccacauccucccu

SEQ ID NO: 13408 - RNA, 19 nt, artificial
  Chemically synthesized
ucaacaugcgagugcggcg

SEQ ID NO: 13409 - RNA, 19 nt, artificial
  Chemically synthesized
gaagcagcagcaggaggag

SEQ ID NO: 13410 - RNA, 19 nt, artificial
  Chemically synthesized
aaguugugugugucugacc

SEQ ID NO: 13411 - RNA, 19 nt, artificial
  Chemically synthesized
agugucccacggacagcag

SEQ ID NO: 13412 - RNA, 19 nt, artificial
  Chemically synthesized
gauccggcaacuggaacag

SEQ ID NO: 13413 - RNA, 19 nt, artificial
  Chemically synthesized
uucuggacucgccuugcca

SEQ ID NO: 13414 - RNA, 19 nt, artificial
  Chemically synthesized
cauaugccugagcguuucg

SEQ ID NO: 13415 - RNA, 19 nt, artificial
  Chemically synthesized
caggcugcuggacgccugg

SEQ ID NO: 13416 - RNA, 19 nt, artificial
  Chemically synthesized
ccugccuggcaccuguguc

SEQ ID NO: 13417 - RNA, 19 nt, artificial
  Chemically synthesized
cacagguggcggccgacug

SEQ ID NO: 13418 - RNA, 19 nt, artificial
  Chemically synthesized
ucucuccaggugcccauca

SEQ ID NO: 13419 - RNA, 19 nt, artificial
  Chemically synthesized
guugucucugaugauuacc

SEQ ID NO: 13420 - RNA, 19 nt, artificial
  Chemically synthesized
aaaagaggugccgccggau

SEQ ID NO: 13421 - RNA, 19 nt, artificial
  Chemically synthesized
ccuuuacagguggccgcug

SEQ ID NO: 13422 - RNA, 19 nt, artificial
  Chemically synthesized
agguucaucacugucugcg

SEQ ID NO: 13423 - RNA, 19 nt, artificial
  Chemically synthesized
cccggucuccuccacaucc

SEQ ID NO: 13424 - RNA, 19 nt, artificial
  Chemically synthesized
acgugcugcuggagcuggg

SEQ ID NO: 13425 - RNA, 19 nt, artificial
  Chemically synthesized
gugcaggagaugauccggc

SEQ ID NO: 13426 - RNA, 19 nt, artificial
  Chemically synthesized
gacucgccuugccaaggcc

SEQ ID NO: 13427 - RNA, 19 nt, artificial
  Chemically synthesized
aucuugaagcagcagcagg

SEQ ID NO: 13428 - RNA, 19 nt, artificial
  Chemically synthesized
cacuggcaggcugcuggac

SEQ ID NO: 13429 - RNA, 19 nt, artificial
  Chemically synthesized
cuccacauccucccuuccc

SEQ ID NO: 13430 - RNA, 19 nt, artificial
  Chemically synthesized
ugccuucaucugcuauugc

SEQ ID NO: 13431 - RNA, 19 nt, artificial
  Chemically synthesized
agguggcggccgacuggac

SEQ ID NO: 13432 - RNA, 19 nt, artificial
  Chemically synthesized
cuugaagcagcagcaggag

SEQ ID NO: 13433 - RNA, 19 nt, artificial
  Chemically synthesized
auaugccugagcguuucga

SEQ ID NO: 13434 - RNA, 19 nt, artificial
  Chemically synthesized
ucgccuugccaaggccuug

SEQ ID NO: 13435 - RNA, 19 nt, artificial
  Chemically synthesized
guucuggacucgccuugcc

SEQ ID NO: 13436 - RNA, 19 nt, artificial
  Chemically synthesized
ugcugcuggagcugggacc

SEQ ID NO: 13437 - RNA, 19 nt, artificial
  Chemically synthesized
ucucaacaugcgagugcgg

SEQ ID NO: 13438 - RNA, 19 nt, artificial
  Chemically synthesized
cauggcugcaggagguccc

SEQ ID NO: 13439 - RNA, 19 nt, artificial
  Chemically synthesized
gcugcuggagcugggaccc

SEQ ID NO: 13440 - RNA, 19 nt, artificial
  Chemically synthesized
ugcggacacagguggcggc

SEQ ID NO: 13441 - RNA, 19 nt, artificial
  Chemically synthesized
ucgacugaaguugugugug

SEQ ID NO: 13442 - RNA, 19 nt, artificial
  Chemically synthesized
gacgacgugcugcuggagc

SEQ ID NO: 13443 - RNA, 19 nt, artificial
  Chemically synthesized
gacgugcugcuggagcugg

SEQ ID NO: 13444 - RNA, 19 nt, artificial
  Chemically synthesized
gugcugcuggagcugggac

SEQ ID NO: 13445 - RNA, 19 nt, artificial
  Chemically synthesized
ugcuuaccaagcugggccg

SEQ ID NO: 13446 - RNA, 19 nt, artificial
  Chemically synthesized
ugugcaggagaugauccgg

SEQ ID NO: 13447 - RNA, 19 nt, artificial
  Chemically synthesized
gaggugccgccggauggug

SEQ ID NO: 13448 - RNA, 19 nt, artificial
  Chemically synthesized
acucgccuugccaaggccu

SEQ ID NO: 13449 - RNA, 19 nt, artificial
  Chemically synthesized
ccaaggccuugucccugcc

SEQ ID NO: 13450 - RNA, 19 nt, artificial
  Chemically synthesized
gauguccugccuggcaccu

SEQ ID NO: 13451 - RNA, 19 nt, artificial
  Chemically synthesized
acuggcaggcugcuggacg

SEQ ID NO: 13452 - RNA, 19 nt, artificial
  Chemically synthesized
uuggagauccggcaacugg

SEQ ID NO: 13453 - RNA, 19 nt, artificial
  Chemically synthesized
caacaugcgagugcggcgc

SEQ ID NO: 13454 - RNA, 19 nt, artificial
  Chemically synthesized
uuugcacucagccucucuc

SEQ ID NO: 13455 - RNA, 19 nt, artificial
  Chemically synthesized
uggacucgccuugccaagg

SEQ ID NO: 13456 - RNA, 19 nt, artificial
  Chemically synthesized
gugcggacacagguggcgg

SEQ ID NO: 13457 - RNA, 19 nt, artificial
  Chemically synthesized
aaggccuugucccugcccu

SEQ ID NO: 13458 - RNA, 19 nt, artificial
  Chemically synthesized
acgugcggacacagguggc

SEQ ID NO: 13459 - RNA, 19 nt, artificial
  Chemically synthesized
cgugcggacacagguggcg

SEQ ID NO: 13460 - RNA, 19 nt, artificial
  Chemically synthesized
aggugccgccggauggugg

SEQ ID NO: 13461 - RNA, 19 nt, artificial
  Chemically synthesized
ucagccucucuccaggugc

SEQ ID NO: 13462 - RNA, 19 nt, artificial
  Chemically synthesized
uugcacucagccucucucc

SEQ ID NO: 13463 - RNA, 19 nt, artificial
  Chemically synthesized
gacacagguggcggccgac

SEQ ID NO: 13464 - RNA, 19 nt, artificial
  Chemically synthesized
ugccaaggccuugucccug

SEQ ID NO: 13465 - RNA, 19 nt, artificial
  Chemically synthesized
cuugccaaggccuuguccc

SEQ ID NO: 13466 - RNA, 19 nt, artificial
  Chemically synthesized
acaugcgagugcggcgccg

SEQ ID NO: 13467 - RNA, 19 nt, artificial
  Chemically synthesized
cucaacaugcgagugcggc

SEQ ID NO: 13468 - RNA, 19 nt, artificial
  Chemically synthesized
cagcagcaggaggaggcug

SEQ ID NO: 13469 - RNA, 19 nt, artificial
  Chemically synthesized
uugugcaggagaugauccg

SEQ ID NO: 13470 - RNA, 19 nt, artificial
  Chemically synthesized
ugcuggacgccuggcaggg

SEQ ID NO: 13471 - RNA, 19 nt, artificial
  Chemically synthesized
uccugccuggcaccugugu

SEQ ID NO: 13472 - RNA, 19 nt, artificial
  Chemically synthesized
cugcuuaccaagcugggcc

SEQ ID NO: 13473 - RNA, 19 nt, artificial
  Chemically synthesized
uuugugcaggagaugaucc

SEQ ID NO: 13474 - RNA, 19 nt, artificial
  Chemically synthesized
gugccgccggaugguggug

SEQ ID NO: 13475 - RNA, 19 nt, artificial
  Chemically synthesized
agcagcagcaggaggaggc

SEQ ID NO: 13476 - RNA, 19 nt, artificial
  Chemically synthesized
uugucccugcccugaagac

SEQ ID NO: 13477 - RNA, 19 nt, artificial
  Chemically synthesized
uugaacgugcggacacagg

SEQ ID NO: 13478 - RNA, 19 nt, artificial
  Chemically synthesized
aacgugcggacacaggugg

SEQ ID NO: 13479 - RNA, 19 nt, artificial
  Chemically synthesized
uaccaagcugggccgcgac

SEQ ID NO: 13480 - RNA, 19 nt, artificial
  Chemically synthesized
ccuugccaaggccuugucc

SEQ ID NO: 13481 - RNA, 19 nt, artificial
  Chemically synthesized
aaagaggugccgccggaug

SEQ ID NO: 13482 - RNA, 19 nt, artificial
  Chemically synthesized
uuucgaugccuucaucugc

SEQ ID NO: 13483 - RNA, 19 nt, artificial
  Chemically synthesized
aagaggugccgccggaugg

SEQ ID NO: 13484 - RNA, 19 nt, artificial
  Chemically synthesized
augauccggcaacuggaac

SEQ ID NO: 13485 - RNA, 19 nt, artificial
  Chemically synthesized
caucgaaaagaggugccgc

SEQ ID NO: 13486 - RNA, 19 nt, artificial
  Chemically synthesized
ugccuggcaccugugucug

SEQ ID NO: 13487 - RNA, 19 nt, artificial
  Chemically synthesized
acacagguggcggccgacu

SEQ ID NO: 13488 - RNA, 19 nt, artificial
  Chemically synthesized
uaucuugaagcagcagcag

SEQ ID NO: 13489 - RNA, 19 nt, artificial
  Chemically synthesized
aagccuuuacagguggccg

SEQ ID NO: 13490 - RNA, 19 nt, artificial
  Chemically synthesized
cuuaccaagcugggccgcg

SEQ ID NO: 13491 - RNA, 19 nt, artificial
  Chemically synthesized
accaagcugggccgcgacg

SEQ ID NO: 13492 - RNA, 19 nt, artificial
  Chemically synthesized
ucuguucuugaacgugcgg

SEQ ID NO: 13493 - RNA, 19 nt, artificial
  Chemically synthesized
cgaaaagaggugccgccgg

SEQ ID NO: 13494 - RNA, 19 nt, artificial
  Chemically synthesized
agccucucuccaggugccc

SEQ ID NO: 13495 - RNA, 19 nt, artificial
  Chemically synthesized
uauaucuugaagcagcagc

SEQ ID NO: 13496 - RNA, 19 nt, artificial
  Chemically synthesized
cucaucgaaaagaggugcc

SEQ ID NO: 13497 - RNA, 19 nt, artificial
  Chemically synthesized
aucuugguucuggacucgc

SEQ ID NO: 13498 - RNA, 19 nt, artificial
  Chemically synthesized
gcuuaccaagcugggccgc

SEQ ID NO: 13499 - RNA, 19 nt, artificial
  Chemically synthesized
augguggugguugucucug

SEQ ID NO: 13500 - RNA, 19 nt, artificial
  Chemically synthesized
aggcugcuggacgccuggc

SEQ ID NO: 13501 - RNA, 19 nt, artificial
  Chemically synthesized
aucgaaaagaggugccgcc

SEQ ID NO: 13502 - RNA, 19 nt, artificial
  Chemically synthesized
acagguggcggccgacugg

SEQ ID NO: 13503 - RNA, 19 nt, artificial
  Chemically synthesized
gaagccuuuacagguggcc

SEQ ID NO: 13504 - RNA, 19 nt, artificial
  Chemically synthesized
auguccugccuggcaccug

SEQ ID NO: 13505 - RNA, 19 nt, artificial
  Chemically synthesized
aagcugggccgcgacgacg

SEQ ID NO: 13506 - RNA, 19 nt, artificial
  Chemically synthesized
uggcaggcugcuggacgcc

SEQ ID NO: 13507 - RNA, 19 nt, artificial
  Chemically synthesized
aacaugcgagugcggcgcc

SEQ ID NO: 13508 - RNA, 19 nt, artificial
  Chemically synthesized
uuacagguggccgcuguag

SEQ ID NO: 13509 - RNA, 19 nt, artificial
  Chemically synthesized
uugaagcagcagcaggagg

SEQ ID NO: 13510 - RNA, 19 nt, artificial
  Chemically synthesized
aagcagcagcaggaggagg

SEQ ID NO: 13511 - RNA, 19 nt, artificial
  Chemically synthesized
ucaucgaaaagaggugccg

SEQ ID NO: 13512 - RNA, 19 nt, artificial
  Chemically synthesized
caaggccuugucccugccc

SEQ ID NO: 13513 - RNA, 19 nt, artificial
  Chemically synthesized
ugccgccggaugguggugg

SEQ ID NO: 13514 - RNA, 19 nt, artificial
  Chemically synthesized
ucgaaaagaggugccgccg

SEQ ID NO: 13515 - RNA, 19 nt, artificial
  Chemically synthesized
auggcugcaggaggucccg

SEQ ID NO: 13516 - RNA, 19 nt, artificial
  Chemically synthesized
uggcugcaggaggucccgg

SEQ ID NO: 13517 - RNA, 19 nt, artificial
  Chemically synthesized
augaaggcaucgaaacgcu

SEQ ID NO: 13518 - RNA, 19 nt, artificial
  Chemically synthesized
uucugaugggcaccuggag

SEQ ID NO: 13519 - RNA, 19 nt, artificial
  Chemically synthesized
ugccaggcguccagcagcc

SEQ ID NO: 13520 - RNA, 19 nt, artificial
  Chemically synthesized
cacugcugucuacagcggc

SEQ ID NO: 13521 - RNA, 19 nt, artificial
  Chemically synthesized
cuucauugccuuguacuug

SEQ ID NO: 13522 - RNA, 19 nt, artificial
  Chemically synthesized
aguugccggaucuccaagu

SEQ ID NO: 13523 - RNA, 19 nt, artificial
  Chemically synthesized
caucuccugcacaaacugg

SEQ ID NO: 13524 - RNA, 19 nt, artificial
  Chemically synthesized
acacugcugucuacagcgg

SEQ ID NO: 13525 - RNA, 19 nt, artificial
  Chemically synthesized
gaagucacauuccuugcuc

SEQ ID NO: 13526 - RNA, 19 nt, artificial
  Chemically synthesized
agugaugaaccucaggaug

SEQ ID NO: 13527 - RNA, 19 nt, artificial
  Chemically synthesized
aaggcaucgaaacgcucag

SEQ ID NO: 13528 - RNA, 19 nt, artificial
  Chemically synthesized
ucuucauugccuuguacuu

SEQ ID NO: 13529 - RNA, 19 nt, artificial
  Chemically synthesized
acagugaugaaccucagga

SEQ ID NO: 13530 - RNA, 19 nt, artificial
  Chemically synthesized
cuggaagucacauuccuug

SEQ ID NO: 13531 - RNA, 19 nt, artificial
  Chemically synthesized
uccugcacaaacuggaugu

SEQ ID NO: 13532 - RNA, 19 nt, artificial
  Chemically synthesized
cucaaaguccaucuccucc

SEQ ID NO: 13533 - RNA, 19 nt, artificial
  Chemically synthesized
ugcuguccgugggacacug

SEQ ID NO: 13534 - RNA, 19 nt, artificial
  Chemically synthesized
aguuugucuguuccaguug

SEQ ID NO: 13535 - RNA, 19 nt, artificial
  Chemically synthesized
accaccaccauccggcggc

SEQ ID NO: 13536 - RNA, 19 nt, artificial
  Chemically synthesized
agagacaaccaccaccauc

SEQ ID NO: 13537 - RNA, 19 nt, artificial
  Chemically synthesized
aaccaagauuuggugcagg

SEQ ID NO: 13538 - RNA, 19 nt, artificial
  Chemically synthesized
gaucuccaaguacucaaag

SEQ ID NO: 13539 - RNA, 19 nt, artificial
  Chemically synthesized
agauauacuuuuggcaauc

SEQ ID NO: 13540 - RNA, 19 nt, artificial
  Chemically synthesized
ccaccuguaaaggcuucuc

SEQ ID NO: 13541 - RNA, 19 nt, artificial
  Chemically synthesized
uguuccaguugccggauca

SEQ ID NO: 13542 - RNA, 19 nt, artificial
  Chemically synthesized
ucuccugcacaaacuggau

SEQ ID NO: 13543 - RNA, 19 nt, artificial
  Chemically synthesized
aguccaucuccuccgccag

SEQ ID NO: 13544 - RNA, 19 nt, artificial
  Chemically synthesized
cauguugagagcagccagg

SEQ ID NO: 13545 - RNA, 19 nt, artificial
  Chemically synthesized
ugaugaaccucaggaugcu

SEQ ID NO: 13546 - RNA, 19 nt, artificial
  Chemically synthesized
accaagauuuggugcaggg

SEQ ID NO: 13547 - RNA, 19 nt, artificial
  Chemically synthesized
ugcugcugcuucaagauau

SEQ ID NO: 13548 - RNA, 19 nt, artificial
  Chemically synthesized
gacacacacaacuucaguc

SEQ ID NO: 13549 - RNA, 19 nt, artificial
  Chemically synthesized
agacagugaugaaccucag

SEQ ID NO: 13550 - RNA, 19 nt, artificial
  Chemically synthesized
ugccggaucaucuccugca

SEQ ID NO: 13551 - RNA, 19 nt, artificial
  Chemically synthesized
aucagucgcuucugauggg

SEQ ID NO: 13552 - RNA, 19 nt, artificial
  Chemically synthesized
cgcacucgcauguugagag

SEQ ID NO: 13553 - RNA, 19 nt, artificial
  Chemically synthesized
acauuccuugcucugcagg

SEQ ID NO: 13554 - RNA, 19 nt, artificial
  Chemically synthesized
agugcaaauuuggucugga

SEQ ID NO: 13555 - RNA, 19 nt, artificial
  Chemically synthesized
gaggcugagugcaaauuug

SEQ ID NO: 13556 - RNA, 19 nt, artificial
  Chemically synthesized
acaacuucagucgauaguu

SEQ ID NO: 13557 - RNA, 19 nt, artificial
  Chemically synthesized
ggacacugcugucuacagc

SEQ ID NO: 13558 - RNA, 19 nt, artificial
  Chemically synthesized
cagcuugguaagcagcucg

SEQ ID NO: 13559 - RNA, 19 nt, artificial
  Chemically synthesized
agucacauuccuugcucug

SEQ ID NO: 13560 - RNA, 19 nt, artificial
  Chemically synthesized
ggucuggaagucacauucc

SEQ ID NO: 13561 - RNA, 19 nt, artificial
  Chemically synthesized
gauaguuugucuguuccag

SEQ ID NO: 13562 - RNA, 19 nt, artificial
  Chemically synthesized
acucgcauguugagagcag

SEQ ID NO: 13563 - RNA, 19 nt, artificial
  Chemically synthesized
gggaacucuuucuucauug

SEQ ID NO: 13564 - RNA, 19 nt, artificial
  Chemically synthesized
caaaguccaucuccuccgc

SEQ ID NO: 13565 - RNA, 19 nt, artificial
  Chemically synthesized
caaacuggaugucgcuggg

SEQ ID NO: 13566 - RNA, 19 nt, artificial
  Chemically synthesized
gaugaaggcaucgaaacgc

SEQ ID NO: 13567 - RNA, 19 nt, artificial
  Chemically synthesized
ucggccgccaccugugucc

SEQ ID NO: 13568 - RNA, 19 nt, artificial
  Chemically synthesized
caguugccggaucaucucc

SEQ ID NO: 13569 - RNA, 19 nt, artificial
  Chemically synthesized
agaggcugagugcaaauuu

SEQ ID NO: 13570 - RNA, 19 nt, artificial
  Chemically synthesized
guuugucuguuccaguugc

SEQ ID NO: 13571 - RNA, 19 nt, artificial
  Chemically synthesized
gaguccagaaccaagauuu

SEQ ID NO: 13572 - RNA, 19 nt, artificial
  Chemically synthesized
gaaacgcucaggcauaugc

SEQ ID NO: 13573 - RNA, 19 nt, artificial
  Chemically synthesized
gucuccaguugccggaucu

SEQ ID NO: 13574 - RNA, 19 nt, artificial
  Chemically synthesized
gucgauaguuugucuguuc

SEQ ID NO: 13575 - RNA, 19 nt, artificial
  Chemically synthesized
uguggugaugcccgccagc

SEQ ID NO: 13576 - RNA, 19 nt, artificial
  Chemically synthesized
auagcagaugaaggcaucg

SEQ ID NO: 13577 - RNA, 19 nt, artificial
  Chemically synthesized
uccagcagccugccagugg

SEQ ID NO: 13578 - RNA, 19 nt, artificial
  Chemically synthesized
uccgcacguucaagaacag

SEQ ID NO: 13579 - RNA, 19 nt, artificial
  Chemically synthesized
uccgugggacacugcuguc

SEQ ID NO: 13580 - RNA, 19 nt, artificial
  Chemically synthesized
agaugaaggcaucgaaacg

SEQ ID NO: 13581 - RNA, 19 nt, artificial
  Chemically synthesized
ucugcuguccgugggacac

SEQ ID NO: 13582 - RNA, 19 nt, artificial
  Chemically synthesized
ucaaugcugggucccagcu

SEQ ID NO: 13583 - RNA, 19 nt, artificial
  Chemically synthesized
auuccuugcucugcaggua

SEQ ID NO: 13584 - RNA, 19 nt, artificial
  Chemically synthesized
uggagagaggcugagugca

SEQ ID NO: 13585 - RNA, 19 nt, artificial
  Chemically synthesized
uagcagaugaaggcaucga

SEQ ID NO: 13586 - RNA, 19 nt, artificial
  Chemically synthesized
cugcacaaacuggaugucg

SEQ ID NO: 13587 - RNA, 19 nt, artificial
  Chemically synthesized
ucuccaguugccggaucuc

SEQ ID NO: 13588 - RNA, 19 nt, artificial
  Chemically synthesized
cucgcauguugagagcagc

SEQ ID NO: 13589 - RNA, 19 nt, artificial
  Chemically synthesized
accaccauccggcggcacc

SEQ ID NO: 13590 - RNA, 19 nt, artificial
  Chemically synthesized
agcagcacgucgucgcggc

SEQ ID NO: 13591 - RNA, 19 nt, artificial
  Chemically synthesized
gugaugaaccucaggaugc

SEQ ID NO: 13592 - RNA, 19 nt, artificial
  Chemically synthesized
gauauacuuuuggcaaucc

SEQ ID NO: 13593 - RNA, 19 nt, artificial
  Chemically synthesized
uuggcaaggcgaguccaga

SEQ ID NO: 13594 - RNA, 19 nt, artificial
  Chemically synthesized
ucccugccaggcguccagc

SEQ ID NO: 13595 - RNA, 19 nt, artificial
  Chemically synthesized
cggaucuccaaguacucaa

SEQ ID NO: 13596 - RNA, 19 nt, artificial
  Chemically synthesized
gaucaucuccugcacaaac

SEQ ID NO: 13597 - RNA, 19 nt, artificial
  Chemically synthesized
guccgcacguucaagaaca

SEQ ID NO: 13598 - RNA, 19 nt, artificial
  Chemically synthesized
uccugcugcugcuucaaga

SEQ ID NO: 13599 - RNA, 19 nt, artificial
  Chemically synthesized
ucauugccuuguacuugau

SEQ ID NO: 13600 - RNA, 19 nt, artificial
  Chemically synthesized
agcuccagcagcacgucgu

SEQ ID NO: 13601 - RNA, 19 nt, artificial
  Chemically synthesized
cagaaccaagauuuggugc

SEQ ID NO: 13602 - RNA, 19 nt, artificial
  Chemically synthesized
aggauguggaggagaccgg

SEQ ID NO: 13603 - RNA, 19 nt, artificial
  Chemically synthesized
acacaacuucagucgauag

SEQ ID NO: 13604 - RNA, 19 nt, artificial
  Chemically synthesized
uccggcggcaccucuuuuc

SEQ ID NO: 13605 - RNA, 19 nt, artificial
  Chemically synthesized
cugcagguaaucaucagag

SEQ ID NO: 13606 - RNA, 19 nt, artificial
  Chemically synthesized
ggaacucuuucuucauugc

SEQ ID NO: 13607 - RNA, 19 nt, artificial
  Chemically synthesized
cagacagugaugaaccuca

SEQ ID NO: 13608 - RNA, 19 nt, artificial
  Chemically synthesized
ucugcagguaaucaucaga

SEQ ID NO: 13609 - RNA, 19 nt, artificial
  Chemically synthesized
gcaaauuuggucuggaagu

SEQ ID NO: 13610 - RNA, 19 nt, artificial
  Chemically synthesized
augggcaccuggagagagg

SEQ ID NO: 13611 - RNA, 19 nt, artificial
  Chemically synthesized
ugggcaccuggagagaggc

SEQ ID NO: 13612 - RNA, 19 nt, artificial
  Chemically synthesized
gucuggaagucacauuccu

SEQ ID NO: 13613 - RNA, 19 nt, artificial
  Chemically synthesized
uuccuugcucugcagguaa

SEQ ID NO: 13614 - RNA, 19 nt, artificial
  Chemically synthesized
caccuguguccgcacguuc

SEQ ID NO: 13615 - RNA, 19 nt, artificial
  Chemically synthesized
gucacauuccuugcucugc

SEQ ID NO: 13616 - RNA, 19 nt, artificial
  Chemically synthesized
cuuucuucauugccuugua

SEQ ID NO: 13617 - RNA, 19 nt, artificial
  Chemically synthesized
agacacaggugccaggcag

SEQ ID NO: 13618 - RNA, 19 nt, artificial
  Chemically synthesized
ucagccuccuccugcugcu

SEQ ID NO: 13619 - RNA, 19 nt, artificial
  Chemically synthesized
aaggccuuggcaaggcgag

SEQ ID NO: 13620 - RNA, 19 nt, artificial
  Chemically synthesized
gucgcagacagugaugaac

SEQ ID NO: 13621 - RNA, 19 nt, artificial
  Chemically synthesized
cuggagagaggcugagugc

SEQ ID NO: 13622 - RNA, 19 nt, artificial
  Chemically synthesized
caggcguccagcagccugc

SEQ ID NO: 13623 - RNA, 19 nt, artificial
  Chemically synthesized
acaggugccaggcaggaca

SEQ ID NO: 13624 - RNA, 19 nt, artificial
  Chemically synthesized
gcuucaagauauacuuuug

SEQ ID NO: 13625 - RNA, 19 nt, artificial
  Chemically synthesized
ugucuacagcggccaccug

SEQ ID NO: 13626 - RNA, 19 nt, artificial
  Chemically synthesized
acagcggccaccuguaaag

SEQ ID NO: 13627 - RNA, 19 nt, artificial
  Chemically synthesized
agacacacacaacuucagu

SEQ ID NO: 13628 - RNA, 19 nt, artificial
  Chemically synthesized
ucagggcagggacaaggcc

SEQ ID NO: 13629 - RNA, 19 nt, artificial
  Chemically synthesized
ccuggagagaggcugagug

SEQ ID NO: 13630 - RNA, 19 nt, artificial
  Chemically synthesized
ucgcuucugaugggcaccu

SEQ ID NO: 13631 - RNA, 19 nt, artificial
  Chemically synthesized
gcugcuucaagauauacuu

SEQ ID NO: 13632 - RNA, 19 nt, artificial
  Chemically synthesized
cacguucaagaacagagac

SEQ ID NO: 13633 - RNA, 19 nt, artificial
  Chemically synthesized
aguccagaaccaagauuug

SEQ ID NO: 13634 - RNA, 19 nt, artificial
  Chemically synthesized
caauagcagaugaaggcau

SEQ ID NO: 13635 - RNA, 19 nt, artificial
  Chemically synthesized
guccagaaccaagauuugg

SEQ ID NO: 13636 - RNA, 19 nt, artificial
  Chemically synthesized
cggucagacacacacaacu

SEQ ID NO: 13637 - RNA, 19 nt, artificial
  Chemically synthesized
caaugcugggucccagcuc

SEQ ID NO: 13638 - RNA, 19 nt, artificial
  Chemically synthesized
ccagaaccaagauuuggug

SEQ ID NO: 13639 - RNA, 19 nt, artificial
  Chemically synthesized
ucgucgcggcccagcuugg

SEQ ID NO: 13640 - RNA, 19 nt, artificial
  Chemically synthesized
acgucgucgcggcccagcu

SEQ ID NO: 13641 - RNA, 19 nt, artificial
  Chemically synthesized
cagaugaaggcaucgaaac

SEQ ID NO: 13642 - RNA, 19 nt, artificial
  Chemically synthesized
aaccaccaccauccggcgg

SEQ ID NO: 13643 - RNA, 19 nt, artificial
  Chemically synthesized
gcauguugagagcagccag

SEQ ID NO: 13644 - RNA, 19 nt, artificial
  Chemically synthesized
cauuccuugcucugcaggu

SEQ ID NO: 13645 - RNA, 19 nt, artificial
  Chemically synthesized
agacaaccaccaccauccg

SEQ ID NO: 13646 - RNA, 19 nt, artificial
  Chemically synthesized
guugccggaucaucuccug

SEQ ID NO: 13647 - RNA, 19 nt, artificial
  Chemically synthesized
cauugccuuguacuugaug

SEQ ID NO: 13648 - RNA, 19 nt, artificial
  Chemically synthesized
cugucuacagcggccaccu

SEQ ID NO: 13649 - RNA, 19 nt, artificial
  Chemically synthesized
gagugcaaauuuggucugg

SEQ ID NO: 13650 - RNA, 19 nt, artificial
  Chemically synthesized
caaguguggugaugcccgc

SEQ ID NO: 13651 - RNA, 19 nt, artificial
  Chemically synthesized
agucgcuucugaugggcac

SEQ ID NO: 13652 - RNA, 19 nt, artificial
  Chemically synthesized
gcugucuacagcggccacc

SEQ ID NO: 13653 - RNA, 19 nt, artificial
  Chemically synthesized
ggcaauagcagaugaaggc

SEQ ID NO: 13654 - RNA, 19 nt, artificial
  Chemically synthesized
accuguguccgcacguuca

SEQ ID NO: 13655 - RNA, 19 nt, artificial
  Chemically synthesized
ucucagccuccuccugcug

SEQ ID NO: 13656 - RNA, 19 nt, artificial
  Chemically synthesized
gucgcuucugaugggcacc

SEQ ID NO: 13657 - RNA, 19 nt, artificial
  Chemically synthesized
gccggaucuccaaguacuc

SEQ ID NO: 13658 - RNA, 19 nt, artificial
  Chemically synthesized
caucagagacaaccaccac

SEQ ID NO: 13659 - RNA, 19 nt, artificial
  Chemically synthesized
agucgauaguuugucuguu

SEQ ID NO: 13660 - RNA, 19 nt, artificial
  Chemically synthesized
gcguccagcagccugccag

SEQ ID NO: 13661 - RNA, 19 nt, artificial
  Chemically synthesized
aguguggugaugcccgcca

SEQ ID NO: 13662 - RNA, 19 nt, artificial
  Chemically synthesized
gcaaggcgaguccagaacc

SEQ ID NO: 13663 - RNA, 19 nt, artificial
  Chemically synthesized
ucccagcuccagcagcacg

SEQ ID NO: 13664 - RNA, 19 nt, artificial
  Chemically synthesized
aggcguccagcagccugcc

SEQ ID NO: 13665 - RNA, 19 nt, artificial
  Chemically synthesized
ucuucagggcagggacaag

SEQ ID NO: 13666 - RNA, 19 nt, artificial
  Chemically synthesized
accagacacaggugccagg

SEQ ID NO: 13667 - RNA, 19 nt, artificial
  Chemically synthesized
aggcgaguccagaaccaag

SEQ ID NO: 13668 - RNA, 19 nt, artificial
  Chemically synthesized
gcagggacaaggccuuggc

SEQ ID NO: 13669 - RNA, 19 nt, artificial
  Chemically synthesized
cucaaugcugggucccagc

SEQ ID NO: 13670 - RNA, 19 nt, artificial
  Chemically synthesized
ugcugucuacagcggccac

SEQ ID NO: 13671 - RNA, 19 nt, artificial
  Chemically synthesized
gucagacacacacaacuuc

SEQ ID NO: 13672 - RNA, 19 nt, artificial
  Chemically synthesized
acaaggccuuggcaaggcg

SEQ ID NO: 13673 - RNA, 19 nt, artificial
  Chemically synthesized
cuguguccgcacguucaag

SEQ ID NO: 13674 - RNA, 19 nt, artificial
  Chemically synthesized
agagaggcugagugcaaau

SEQ ID NO: 13675 - RNA, 19 nt, artificial
  Chemically synthesized
uccuccugcugcugcuuca

SEQ ID NO: 13676 - RNA, 19 nt, artificial
  Chemically synthesized
caguugccggaucuccaag

SEQ ID NO: 13677 - RNA, 19 nt, artificial
  Chemically synthesized
gcagguaaucaucagagac

SEQ ID NO: 13678 - RNA, 19 nt, artificial
  Chemically synthesized
cagacacacacaacuucag

SEQ ID NO: 13679 - RNA, 19 nt, artificial
  Chemically synthesized
cagugaugaaccucaggau

SEQ ID NO: 13680 - RNA, 19 nt, artificial
  Chemically synthesized
gaagggaggauguggagga

SEQ ID NO: 13681 - RNA, 19 nt, artificial
  Chemically synthesized
ggaagucacauuccuugcu

SEQ ID NO: 13682 - RNA, 19 nt, artificial
  Chemically synthesized
ccaguugccggaucaucuc

SEQ ID NO: 13683 - RNA, 19 nt, artificial
  Chemically synthesized
cucuuucuucauugccuug

SEQ ID NO: 13684 - RNA, 19 nt, artificial
  Chemically synthesized
cuccugcacaaacuggaug

SEQ ID NO: 13685 - RNA, 19 nt, artificial
  Chemically synthesized
aggcaucgaaacgcucagg

SEQ ID NO: 13686 - RNA, 19 nt, artificial
  Chemically synthesized
caaccaccaccauccggcg

SEQ ID NO: 13687 - RNA, 19 nt, artificial
  Chemically synthesized
ccuugcucugcagguaauc

SEQ ID NO: 13688 - RNA, 19 nt, artificial
  Chemically synthesized
ugcagguaaucaucagaga

SEQ ID NO: 13689 - RNA, 19 nt, artificial
  Chemically synthesized
ggcuucucagccuccuccu

SEQ ID NO: 13690 - RNA, 19 nt, artificial
  Chemically synthesized
cacauuccuugcucugcag

SEQ ID NO: 13691 - RNA, 19 nt, artificial
  Chemically synthesized
acuucagucgauaguuugu

SEQ ID NO: 13692 - RNA, 19 nt, artificial
  Chemically synthesized
agaccagacacaggugcca

SEQ ID NO: 13693 - RNA, 19 nt, artificial
  Chemically synthesized
ggcaccuggagagaggcug

SEQ ID NO: 13694 - RNA, 19 nt, artificial
  Chemically synthesized
ugcugggucccagcuccag

SEQ ID NO: 13695 - RNA, 19 nt, artificial
  Chemically synthesized
cacaacuucagucgauagu

SEQ ID NO: 13696 - RNA, 19 nt, artificial
  Chemically synthesized
caagauauacuuuuggcaa

SEQ ID NO: 13697 - RNA, 19 nt, artificial
  Chemically synthesized
gcuucugaugggcaccugg

SEQ ID NO: 13698 - RNA, 19 nt, artificial
  Chemically synthesized
gucccugccaggcguccag

SEQ ID NO: 13699 - RNA, 19 nt, artificial
  Chemically synthesized
cuguccgugggacacugcu

SEQ ID NO: 13700 - RNA, 19 nt, artificial
  Chemically synthesized
gcagacagugaugaaccuc

SEQ ID NO: 13701 - RNA, 19 nt, artificial
  Chemically synthesized
agcggccaccuguaaaggc

SEQ ID NO: 13702 - RNA, 19 nt, artificial
  Chemically synthesized
cacaaacuggaugucgcug

SEQ ID NO: 13703 - RNA, 19 nt, artificial
  Chemically synthesized
cuugcucugcagguaauca

SEQ ID NO: 13704 - RNA, 19 nt, artificial
  Chemically synthesized
aagggaggauguggaggag

SEQ ID NO: 13705 - RNA, 19 nt, artificial
  Chemically synthesized
acacacaacuucagucgau

SEQ ID NO: 13706 - RNA, 19 nt, artificial
  Chemically synthesized
gacaaccaccaccauccgg

SEQ ID NO: 13707 - RNA, 19 nt, artificial
  Chemically synthesized
cucugcagguaaucaucag

SEQ ID NO: 13708 - RNA, 19 nt, artificial
  Chemically synthesized
ggaagggaggauguggagg

SEQ ID NO: 13709 - RNA, 19 nt, artificial
  Chemically synthesized
cugccaggcguccagcagc

SEQ ID NO: 13710 - RNA, 19 nt, artificial
  Chemically synthesized
gaugaaccucaggaugcug

SEQ ID NO: 13711 - RNA, 19 nt, artificial
  Chemically synthesized
ccaucuccuccgccagcgc

SEQ ID NO: 13712 - RNA, 19 nt, artificial
  Chemically synthesized
ggaucuccaaguacucaaa

SEQ ID NO: 13713 - RNA, 19 nt, artificial
  Chemically synthesized
ccagcuugguaagcagcuc

SEQ ID NO: 13714 - RNA, 19 nt, artificial
  Chemically synthesized
gaccagacacaggugccag

SEQ ID NO: 13715 - RNA, 19 nt, artificial
  Chemically synthesized
ggcaucgaaacgcucaggc

SEQ ID NO: 13716 - RNA, 19 nt, artificial
  Chemically synthesized
ucuacagcggccaccugua

SEQ ID NO: 13717 - RNA, 19 nt, artificial
  Chemically synthesized
ucugaugggcaccuggaga

SEQ ID NO: 13718 - RNA, 19 nt, artificial
  Chemically synthesized
gccuuggcaaggcgagucc

SEQ ID NO: 13719 - RNA, 19 nt, artificial
  Chemically synthesized
aaggcgaguccagaaccaa

SEQ ID NO: 13720 - RNA, 19 nt, artificial
  Chemically synthesized
ccaaguacucaaaguccau

SEQ ID NO: 13721 - RNA, 19 nt, artificial
  Chemically synthesized
ccagacacaggugccaggc

SEQ ID NO: 13722 - RNA, 19 nt, artificial
  Chemically synthesized
cgugggacacugcugucua

SEQ ID NO: 13723 - RNA, 19 nt, artificial
  Chemically synthesized
cgauaguuugucuguucca

SEQ ID NO: 13724 - RNA, 19 nt, artificial
  Chemically synthesized
guccgugggacacugcugu

SEQ ID NO: 13725 - RNA, 19 nt, artificial
  Chemically synthesized
gcacaaacuggaugucgcu

SEQ ID NO: 13726 - RNA, 19 nt, artificial
  Chemically synthesized
cgcauguugagagcagcca

SEQ ID NO: 13727 - RNA, 19 nt, artificial
  Chemically synthesized
caacuucagucgauaguuu

SEQ ID NO: 13728 - RNA, 19 nt, artificial
  Chemically synthesized
gccaccuguaaaggcuucu

SEQ ID NO: 13729 - RNA, 19 nt, artificial
  Chemically synthesized
cugaugggcaccuggagag

SEQ ID NO: 13730 - RNA, 19 nt, artificial
  Chemically synthesized
ggaucagucgcuucugaug

SEQ ID NO: 13731 - RNA, 19 nt, artificial
  Chemically synthesized
gacagugaugaaccucagg

SEQ ID NO: 13732 - RNA, 19 nt, artificial
  Chemically synthesized
cacucgcauguugagagca

SEQ ID NO: 13733 - RNA, 19 nt, artificial
  Chemically synthesized
cagucgauaguuugucugu

SEQ ID NO: 13734 - RNA, 19 nt, artificial
  Chemically synthesized
guccaucuccuccgccagc

SEQ ID NO: 13735 - RNA, 19 nt, artificial
  Chemically synthesized
augcugggucccagcucca

SEQ ID NO: 13736 - RNA, 19 nt, artificial
  Chemically synthesized
accuggagagaggcugagu

SEQ ID NO: 13737 - RNA, 19 nt, artificial
  Chemically synthesized
gaaccaagauuuggugcag

SEQ ID NO: 13738 - RNA, 19 nt, artificial
  Chemically synthesized
gucuacagcggccaccugu

SEQ ID NO: 13739 - RNA, 19 nt, artificial
  Chemically synthesized
cuccucaaugcuggguccc

SEQ ID NO: 13740 - RNA, 19 nt, artificial
  Chemically synthesized
gcacguucaagaacagaga

SEQ ID NO: 13741 - RNA, 19 nt, artificial
  Chemically synthesized
gaaggcaucgaaacgcuca

SEQ ID NO: 13742 - RNA, 19 nt, artificial
  Chemically synthesized
cagguaaucaucagagaca

SEQ ID NO: 13743 - RNA, 19 nt, artificial
  Chemically synthesized
gugggacacugcugucuac

SEQ ID NO: 13744 - RNA, 19 nt, artificial
  Chemically synthesized
gggcaauagcagaugaagg

SEQ ID NO: 13745 - RNA, 19 nt, artificial
  Chemically synthesized
cuuggcaaggcgaguccag

SEQ ID NO: 13746 - RNA, 19 nt, artificial
  Chemically synthesized
gcugggucccagcuccagc

SEQ ID NO: 13747 - RNA, 19 nt, artificial
  Chemically synthesized
gucuguuccaguugccgga

SEQ ID NO: 13748 - RNA, 19 nt, artificial
  Chemically synthesized
ccggaucuccaaguacuca

SEQ ID NO: 13749 - RNA, 19 nt, artificial
  Chemically synthesized
ugggucccagcuccagcag

SEQ ID NO: 13750 - RNA, 19 nt, artificial
  Chemically synthesized
agcagaugaaggcaucgaa

SEQ ID NO: 13751 - RNA, 19 nt, artificial
  Chemically synthesized
ggaggauguggaggagacc

SEQ ID NO: 13752 - RNA, 19 nt, artificial
  Chemically synthesized
cugcugcuucaagauauac

SEQ ID NO: 13753 - RNA, 19 nt, artificial
  Chemically synthesized
uccucaaugcuggguccca

SEQ ID NO: 13754 - RNA, 19 nt, artificial
  Chemically synthesized
accauccggcggcaccucu

SEQ ID NO: 13755 - RNA, 19 nt, artificial
  Chemically synthesized
aucgaaacgcucaggcaua

SEQ ID NO: 13756 - RNA, 19 nt, artificial
  Chemically synthesized
ucgcggcccagcuugguaa

SEQ ID NO: 13757 - RNA, 19 nt, artificial
  Chemically synthesized
gggacacugcugucuacag

SEQ ID NO: 13758 - RNA, 19 nt, artificial
  Chemically synthesized
ccugcacaaacuggauguc

SEQ ID NO: 13759 - RNA, 19 nt, artificial
  Chemically synthesized
ggugccaggcaggacaucg

SEQ ID NO: 13760 - RNA, 19 nt, artificial
  Chemically synthesized
agccuccuccugcugcugc

SEQ ID NO: 13761 - RNA, 19 nt, artificial
  Chemically synthesized
caccuggagagaggcugag

SEQ ID NO: 13762 - RNA, 19 nt, artificial
  Chemically synthesized
uacagcggccaccuguaaa

SEQ ID NO: 13763 - RNA, 19 nt, artificial
  Chemically synthesized
ccgugggacacugcugucu

SEQ ID NO: 13764 - RNA, 19 nt, artificial
  Chemically synthesized
cuccagcagcacgucgucg

SEQ ID NO: 13765 - RNA, 19 nt, artificial
  Chemically synthesized
gcacucgcauguugagagc

SEQ ID NO: 13766 - RNA, 19 nt, artificial
  Chemically synthesized
gcuguccgugggacacugc

SEQ ID NO: 13767 - RNA, 19 nt, artificial
  Chemically synthesized
cugggucccagcuccagca

SEQ ID NO: 13768 - RNA, 19 nt, artificial
  Chemically synthesized
cagcagcacgucgucgcgg

SEQ ID NO: 13769 - RNA, 19 nt, artificial
  Chemically synthesized
uccuugcucugcagguaau

SEQ ID NO: 13770 - RNA, 19 nt, artificial
  Chemically synthesized
guugccggaucuccaagua

SEQ ID NO: 13771 - RNA, 19 nt, artificial
  Chemically synthesized
gcggccaccuguaaaggcu

SEQ ID NO: 13772 - RNA, 19 nt, artificial
  Chemically synthesized
ccucaaugcugggucccag

SEQ ID NO: 13773 - RNA, 19 nt, artificial
  Chemically synthesized
cuucugaugggcaccugga

SEQ ID NO: 13774 - RNA, 19 nt, artificial
  Chemically synthesized
ucuguuccaguugccggau

SEQ ID NO: 13775 - RNA, 19 nt, artificial
  Chemically synthesized
ccugccaggcguccagcag

SEQ ID NO: 13776 - RNA, 19 nt, artificial
  Chemically synthesized
gcuucucagccuccuccug

SEQ ID NO: 13777 - RNA, 19 nt, artificial
  Chemically synthesized
gaggauguggaggagaccg

SEQ ID NO: 13778 - RNA, 19 nt, artificial
  Chemically synthesized
cagucgcuucugaugggca

SEQ ID NO: 13779 - RNA, 19 nt, artificial
  Chemically synthesized
cugcugucuacagcggcca

SEQ ID NO: 13780 - RNA, 19 nt, artificial
  Chemically synthesized
caaggcgaguccagaacca

SEQ ID NO: 13781 - RNA, 19 nt, artificial
  Chemically synthesized
ccagcagccugccaguggg

SEQ ID NO: 13782 - RNA, 19 nt, artificial
  Chemically synthesized
cacacaacuucagucgaua

SEQ ID NO: 13783 - RNA, 19 nt, artificial
  Chemically synthesized
gcggucagacacacacaac

SEQ ID NO: 13784 - RNA, 19 nt, artificial
  Chemically synthesized
ggcugagugcaaauuuggu

SEQ ID NO: 13785 - RNA, 19 nt, artificial
  Chemically synthesized
gucgucgcggcccagcuug

SEQ ID NO: 13786 - RNA, 19 nt, artificial
  Chemically synthesized
gggaucagucgcuucugau

SEQ ID NO: 13787 - RNA, 19 nt, artificial
  Chemically synthesized
agguaaucaucagagacaa

SEQ ID NO: 13788 - RNA, 19 nt, artificial
  Chemically synthesized
gcaccucuuuucgaugagc

SEQ ID NO: 13789 - RNA, 19 nt, artificial
  Chemically synthesized
gugcaaauuuggucuggaa

SEQ ID NO: 13790 - RNA, 19 nt, artificial
  Chemically synthesized
guguggugaugcccgccag

SEQ ID NO: 13791 - RNA, 19 nt, artificial
  Chemically synthesized
cgucccugccaggcgucca

SEQ ID NO: 13792 - RNA, 19 nt, artificial
  Chemically synthesized
cacaggugccaggcaggac

SEQ ID NO: 13793 - RNA, 19 nt, artificial
  Chemically synthesized
cugcuucaagauauacuuu

SEQ ID NO: 13794 - RNA, 19 nt, artificial
  Chemically synthesized
gagaggcugagugcaaauu

SEQ ID NO: 13795 - RNA, 19 nt, artificial
  Chemically synthesized
uccagucggccgccaccug

SEQ ID NO: 13796 - RNA, 19 nt, artificial
  Chemically synthesized
gacaaggccuuggcaaggc

SEQ ID NO: 13797 - RNA, 19 nt, artificial
  Chemically synthesized
cgaguccagaaccaagauu

SEQ ID NO: 13798 - RNA, 19 nt, artificial
  Chemically synthesized
agcacgucgucgcggccca

SEQ ID NO: 13799 - RNA, 19 nt, artificial
  Chemically synthesized
cagcuccagcagcacgucg

SEQ ID NO: 13800 - RNA, 19 nt, artificial
  Chemically synthesized
guguccgcacguucaagaa

SEQ ID NO: 13801 - RNA, 19 nt, artificial
  Chemically synthesized
gggaggauguggaggagac

SEQ ID NO: 13802 - RNA, 19 nt, artificial
  Chemically synthesized
gaugggcaccuggagagag

SEQ ID NO: 13803 - RNA, 19 nt, artificial
  Chemically synthesized
cgcuucugaugggcaccug

SEQ ID NO: 13804 - RNA, 19 nt, artificial
  Chemically synthesized
gcaucgaaacgcucaggca

SEQ ID NO: 13805 - RNA, 19 nt, artificial
  Chemically synthesized
cagggcagggacaaggccu

SEQ ID NO: 13806 - RNA, 19 nt, artificial
  Chemically synthesized
caucgaaacgcucaggcau

SEQ ID NO: 13807 - RNA, 19 nt, artificial
  Chemically synthesized
cucagccuccuccugcugc

SEQ ID NO: 13808 - RNA, 19 nt, artificial
  Chemically synthesized
agggacaaggccuuggcaa

SEQ ID NO: 13809 - RNA, 19 nt, artificial
  Chemically synthesized
ccagcagcacgucgucgcg

SEQ ID NO: 13810 - RNA, 19 nt, artificial
  Chemically synthesized
ggcgaguccagaaccaaga

SEQ ID NO: 13811 - RNA, 19 nt, artificial
  Chemically synthesized
gcucugcagguaaucauca

SEQ ID NO: 13812 - RNA, 19 nt, artificial
  Chemically synthesized
gcccagcuugguaagcagc

SEQ ID NO: 13813 - RNA, 19 nt, artificial
  Chemically synthesized
cccagcuugguaagcagcu

SEQ ID NO: 13814 - RNA, 19 nt, artificial
  Chemically synthesized
cucugcuguccgugggaca

SEQ ID NO: 13815 - RNA, 19 nt, artificial
  Chemically synthesized
agggaggauguggaggaga

SEQ ID NO: 13816 - RNA, 19 nt, artificial
  Chemically synthesized
cgccgcacucgcauguuga

SEQ ID NO: 13817 - RNA, 19 nt, artificial
  Chemically synthesized
cuccuccugcugcugcuuc

SEQ ID NO: 13818 - RNA, 19 nt, artificial
  Chemically synthesized
ggucagacacacacaacuu

SEQ ID NO: 13819 - RNA, 19 nt, artificial
  Chemically synthesized
cugcuguccgugggacacu

SEQ ID NO: 13820 - RNA, 19 nt, artificial
  Chemically synthesized
cuguuccaguugccggauc

SEQ ID NO: 13821 - RNA, 19 nt, artificial
  Chemically synthesized
uggcaaggcgaguccagaa

SEQ ID NO: 13822 - RNA, 19 nt, artificial
  Chemically synthesized
cgaaacgcucaggcauaug

SEQ ID NO: 13823 - RNA, 19 nt, artificial
  Chemically synthesized
ccaggcguccagcagccug

SEQ ID NO: 13824 - RNA, 19 nt, artificial
  Chemically synthesized
gacacaggugccaggcagg

SEQ ID NO: 13825 - RNA, 19 nt, artificial
  Chemically synthesized
cagucggccgccaccugug

SEQ ID NO: 13826 - RNA, 19 nt, artificial
  Chemically synthesized
ugaugggcaccuggagaga

SEQ ID NO: 13827 - RNA, 19 nt, artificial
  Chemically synthesized
gguaaucaucagagacaac

SEQ ID NO: 13828 - RNA, 19 nt, artificial
  Chemically synthesized
auccggcggcaccucuuuu

SEQ ID NO: 13829 - RNA, 19 nt, artificial
  Chemically synthesized
cagcggccaccuguaaagg

SEQ ID NO: 13830 - RNA, 19 nt, artificial
  Chemically synthesized
cgcagacagugaugaaccu

SEQ ID NO: 13831 - RNA, 19 nt, artificial
  Chemically synthesized
ggauguggaggagaccggg

SEQ ID NO: 13832 - RNA, 19 nt, artificial
  Chemically synthesized
cccagcuccagcagcacgu

SEQ ID NO: 13833 - RNA, 19 nt, artificial
  Chemically synthesized
gccggaucaucuccugcac

SEQ ID NO: 13834 - RNA, 19 nt, artificial
  Chemically synthesized
ggccuuggcaaggcgaguc

SEQ ID NO: 13835 - RNA, 19 nt, artificial
  Chemically synthesized
ccugcugcugcuucaagau

SEQ ID NO: 13836 - RNA, 19 nt, artificial
  Chemically synthesized
guccagcagccugccagug

SEQ ID NO: 13837 - RNA, 19 nt, artificial
  Chemically synthesized
gggaagggaggauguggag

SEQ ID NO: 13838 - RNA, 19 nt, artificial
  Chemically synthesized
gcaauagcagaugaaggca

SEQ ID NO: 13839 - RNA, 19 nt, artificial
  Chemically synthesized
guccagucggccgccaccu

SEQ ID NO: 13840 - RNA, 19 nt, artificial
  Chemically synthesized
cuccugcugcugcuucaag

SEQ ID NO: 13841 - RNA, 19 nt, artificial
  Chemically synthesized
ucgaaacgcucaggcauau

SEQ ID NO: 13842 - RNA, 19 nt, artificial
  Chemically synthesized
caaggccuuggcaaggcga

SEQ ID NO: 13843 - RNA, 19 nt, artificial
  Chemically synthesized
ggcaaggcgaguccagaac

SEQ ID NO: 13844 - RNA, 19 nt, artificial
  Chemically synthesized
ggucccagcuccagcagca

SEQ ID NO: 13845 - RNA, 19 nt, artificial
  Chemically synthesized
ccgcacucgcauguugaga

SEQ ID NO: 13846 - RNA, 19 nt, artificial
  Chemically synthesized
gggaccuccugcagccaug

SEQ ID NO: 13847 - RNA, 19 nt, artificial
  Chemically synthesized
gggucccagcuccagcagc

SEQ ID NO: 13848 - RNA, 19 nt, artificial
  Chemically synthesized
gccgccaccuguguccgca

SEQ ID NO: 13849 - RNA, 19 nt, artificial
  Chemically synthesized
cacacacaacuucagucga

SEQ ID NO: 13850 - RNA, 19 nt, artificial
  Chemically synthesized
gcuccagcagcacgucguc

SEQ ID NO: 13851 - RNA, 19 nt, artificial
  Chemically synthesized
ccagcuccagcagcacguc

SEQ ID NO: 13852 - RNA, 19 nt, artificial
  Chemically synthesized
gucccagcuccagcagcac

SEQ ID NO: 13853 - RNA, 19 nt, artificial
  Chemically synthesized
cggcccagcuugguaagca

SEQ ID NO: 13854 - RNA, 19 nt, artificial
  Chemically synthesized
ccggaucaucuccugcaca

SEQ ID NO: 13855 - RNA, 19 nt, artificial
  Chemically synthesized
caccauccggcggcaccuc

SEQ ID NO: 13856 - RNA, 19 nt, artificial
  Chemically synthesized
aggccuuggcaaggcgagu

SEQ ID NO: 13857 - RNA, 19 nt, artificial
  Chemically synthesized
ggcagggacaaggccuugg

SEQ ID NO: 13858 - RNA, 19 nt, artificial
  Chemically synthesized
aggugccaggcaggacauc

SEQ ID NO: 13859 - RNA, 19 nt, artificial
  Chemically synthesized
cguccagcagccugccagu

SEQ ID NO: 13860 - RNA, 19 nt, artificial
  Chemically synthesized
ccaguugccggaucuccaa

SEQ ID NO: 13861 - RNA, 19 nt, artificial
  Chemically synthesized
gcgccgcacucgcauguug

SEQ ID NO: 13862 - RNA, 19 nt, artificial
  Chemically synthesized
gagagaggcugagugcaaa

SEQ ID NO: 13863 - RNA, 19 nt, artificial
  Chemically synthesized
ccuuggcaaggcgagucca

SEQ ID NO: 13864 - RNA, 19 nt, artificial
  Chemically synthesized
ccgccaccuguguccgcac

SEQ ID NO: 13865 - RNA, 19 nt, artificial
  Chemically synthesized
agggcagggacaaggccuu

SEQ ID NO: 13866 - RNA, 19 nt, artificial
  Chemically synthesized
gccaccuguguccgcacgu

SEQ ID NO: 13867 - RNA, 19 nt, artificial
  Chemically synthesized
cgccaccuguguccgcacg

SEQ ID NO: 13868 - RNA, 19 nt, artificial
  Chemically synthesized
ccaccauccggcggcaccu

SEQ ID NO: 13869 - RNA, 19 nt, artificial
  Chemically synthesized
gcaccuggagagaggcuga

SEQ ID NO: 13870 - RNA, 19 nt, artificial
  Chemically synthesized
ggagagaggcugagugcaa

SEQ ID NO: 13871 - RNA, 19 nt, artificial
  Chemically synthesized
gucggccgccaccuguguc

SEQ ID NO: 13872 - RNA, 19 nt, artificial
  Chemically synthesized
cagggacaaggccuuggca

SEQ ID NO: 13873 - RNA, 19 nt, artificial
  Chemically synthesized
gggacaaggccuuggcaag

SEQ ID NO: 13874 - RNA, 19 nt, artificial
  Chemically synthesized
cggcgccgcacucgcaugu

SEQ ID NO: 13875 - RNA, 19 nt, artificial
  Chemically synthesized
gccgcacucgcauguugag

SEQ ID NO: 13876 - RNA, 19 nt, artificial
  Chemically synthesized
cagccuccuccugcugcug

SEQ ID NO: 13877 - RNA, 19 nt, artificial
  Chemically synthesized
cggaucaucuccugcacaa

SEQ ID NO: 13878 - RNA, 19 nt, artificial
  Chemically synthesized
cccugccaggcguccagca

SEQ ID NO: 13879 - RNA, 19 nt, artificial
  Chemically synthesized
acacaggugccaggcagga

SEQ ID NO: 13880 - RNA, 19 nt, artificial
  Chemically synthesized
ggcccagcuugguaagcag

SEQ ID NO: 13881 - RNA, 19 nt, artificial
  Chemically synthesized
ggaucaucuccugcacaaa

SEQ ID NO: 13882 - RNA, 19 nt, artificial
  Chemically synthesized
caccaccauccggcggcac

SEQ ID NO: 13883 - RNA, 19 nt, artificial
  Chemically synthesized
gccuccuccugcugcugcu

SEQ ID NO: 13884 - RNA, 19 nt, artificial
  Chemically synthesized
gucuucagggcagggacaa

SEQ ID NO: 13885 - RNA, 19 nt, artificial
  Chemically synthesized
ccuguguccgcacguucaa

SEQ ID NO: 13886 - RNA, 19 nt, artificial
  Chemically synthesized
ccaccuguguccgcacguu

SEQ ID NO: 13887 - RNA, 19 nt, artificial
  Chemically synthesized
gucgcggcccagcuuggua

SEQ ID NO: 13888 - RNA, 19 nt, artificial
  Chemically synthesized
ggacaaggccuuggcaagg

SEQ ID NO: 13889 - RNA, 19 nt, artificial
  Chemically synthesized
cauccggcggcaccucuuu

SEQ ID NO: 13890 - RNA, 19 nt, artificial
  Chemically synthesized
gcagaugaaggcaucgaaa

SEQ ID NO: 13891 - RNA, 19 nt, artificial
  Chemically synthesized
ccauccggcggcaccucuu

SEQ ID NO: 13892 - RNA, 19 nt, artificial
  Chemically synthesized
guuccaguugccggaucau

SEQ ID NO: 13893 - RNA, 19 nt, artificial
  Chemically synthesized
gcggcaccucuuuucgaug

SEQ ID NO: 13894 - RNA, 19 nt, artificial
  Chemically synthesized
cagacacaggugccaggca

SEQ ID NO: 13895 - RNA, 19 nt, artificial
  Chemically synthesized
agucggccgccaccugugu

SEQ ID NO: 13896 - RNA, 19 nt, artificial
  Chemically synthesized
cugcugcugcuucaagaua

SEQ ID NO: 13897 - RNA, 19 nt, artificial
  Chemically synthesized
cggccaccuguaaaggcuu

SEQ ID NO: 13898 - RNA, 19 nt, artificial
  Chemically synthesized
cgcggcccagcuugguaag

SEQ ID NO: 13899 - RNA, 19 nt, artificial
  Chemically synthesized
cgucgcggcccagcuuggu

SEQ ID NO: 13900 - RNA, 19 nt, artificial
  Chemically synthesized
ccgcacguucaagaacaga

SEQ ID NO: 13901 - RNA, 19 nt, artificial
  Chemically synthesized
ccggcggcaccucuuuucg

SEQ ID NO: 13902 - RNA, 19 nt, artificial
  Chemically synthesized
gggcaccuggagagaggcu

SEQ ID NO: 13903 - RNA, 19 nt, artificial
  Chemically synthesized
gcugcugcuucaagauaua

SEQ ID NO: 13904 - RNA, 19 nt, artificial
  Chemically synthesized
ggcaccucuuuucgaugag

SEQ ID NO: 13905 - RNA, 19 nt, artificial
  Chemically synthesized
gcgaguccagaaccaagau

SEQ ID NO: 13906 - RNA, 19 nt, artificial
  Chemically synthesized
gcggcccagcuugguaagc

SEQ ID NO: 13907 - RNA, 19 nt, artificial
  Chemically synthesized
cagagacaaccaccaccau

SEQ ID NO: 13908 - RNA, 19 nt, artificial
  Chemically synthesized
gccaggcguccagcagccu

SEQ ID NO: 13909 - RNA, 19 nt, artificial
  Chemically synthesized
ggcggcaccucuuuucgau

SEQ ID NO: 13910 - RNA, 19 nt, artificial
  Chemically synthesized
ccagucggccgccaccugu

SEQ ID NO: 13911 - RNA, 19 nt, artificial
  Chemically synthesized
ggccaccuguaaaggcuuc

SEQ ID NO: 13912 - RNA, 19 nt, artificial
  Chemically synthesized
caggugccaggcaggacau

SEQ ID NO: 13913 - RNA, 19 nt, artificial
  Chemically synthesized
cgucgucgcggcccagcuu

SEQ ID NO: 13914 - RNA, 19 nt, artificial
  Chemically synthesized
ggcguccagcagccugcca

SEQ ID NO: 13915 - RNA, 19 nt, artificial
  Chemically synthesized
ggcgccgcacucgcauguu

SEQ ID NO: 13916 - RNA, 19 nt, artificial
  Chemically synthesized
cuacagcggccaccuguaa

SEQ ID NO: 13917 - RNA, 19 nt, artificial
  Chemically synthesized
ccuccugcugcugcuucaa

SEQ ID NO: 13918 - RNA, 19 nt, artificial
  Chemically synthesized
ccuccuccugcugcugcuu

SEQ ID NO: 13919 - RNA, 19 nt, artificial
  Chemically synthesized
cggcaccucuuuucgauga

SEQ ID NO: 13920 - RNA, 19 nt, artificial
  Chemically synthesized
gggcagggacaaggccuug

SEQ ID NO: 13921 - RNA, 19 nt, artificial
  Chemically synthesized
ccaccaccauccggcggca

SEQ ID NO: 13922 - RNA, 19 nt, artificial
  Chemically synthesized
cggcggcaccucuuuucga

SEQ ID NO: 13923 - RNA, 19 nt, artificial
  Chemically synthesized
cgggaccuccugcagccau

SEQ ID NO: 13924 - RNA, 19 nt, Artificial Sequence
  Chemically synthesized
ccgggaccuccugcagcca

SEQ ID NO: 13925 - RNA, 18 nt, artificial
  Chemically synthesized
ggcuguugcuggacuaca

SEQ ID NO: 13926 - RNA, 18 nt, artificial
  Chemically synthesized
ggcaucuucuacauguuu

SEQ ID NO: 13927 - RNA, 18 nt, artificial
  Chemically synthesized
cucgagaccucaagggua

SEQ ID NO: 13928 - RNA, 18 nt, artificial
  Chemically synthesized
ccuauauccuggaauaua

SEQ ID NO: 13929 - RNA, 18 nt, artificial
  Chemically synthesized
ggcauauucaucaaguau

SEQ ID NO: 13930 - RNA, 18 nt, artificial
  Chemically synthesized
ggaggaaucugugcucua

SEQ ID NO: 13931 - RNA, 18 nt, artificial
  Chemically synthesized
ggcugagaagccuuuaca

SEQ ID NO: 13932 - RNA, 18 nt, artificial
  Chemically synthesized
gacccaauguaccaguau

SEQ ID NO: 13933 - RNA, 18 nt, artificial
  Chemically synthesized
ggagauggacuuugagua

SEQ ID NO: 13934 - RNA, 18 nt, artificial
  Chemically synthesized
gguugucucugaugauua

SEQ ID NO: 13935 - RNA, 18 nt, artificial
  Chemically synthesized
cccucaguuuccucacuu

SEQ ID NO: 13936 - RNA, 18 nt, artificial
  Chemically synthesized
ggaugguggugguugucu

SEQ ID NO: 13937 - RNA, 18 nt, artificial
  Chemically synthesized
gaaucugugcucuacuua

SEQ ID NO: 13938 - RNA, 18 nt, artificial
  Chemically synthesized
ccaauguaccaguauuua

SEQ ID NO: 13939 - RNA, 18 nt, artificial
  Chemically synthesized
gggagaaggugccauggu

SEQ ID NO: 13940 - RNA, 18 nt, artificial
  Chemically synthesized
agcugagacuaagaagga

SEQ ID NO: 13941 - RNA, 18 nt, artificial
  Chemically synthesized
gggagaacagagaguagc

SEQ ID NO: 13942 - RNA, 18 nt, artificial
  Chemically synthesized
gaggcaucuucuacaugu

SEQ ID NO: 13943 - RNA, 18 nt, artificial
  Chemically synthesized
cggcaacuggagacacaa

SEQ ID NO: 13944 - RNA, 18 nt, artificial
  Chemically synthesized
ggguguguguguaucugu

SEQ ID NO: 13945 - RNA, 18 nt, artificial
  Chemically synthesized
ggauuaucagccaggaca

SEQ ID NO: 13946 - RNA, 18 nt, artificial
  Chemically synthesized
gcaucuucuacauguuuu

SEQ ID NO: 13947 - RNA, 18 nt, artificial
  Chemically synthesized
gucuauugcuagugagcu

SEQ ID NO: 13948 - RNA, 18 nt, artificial
  Chemically synthesized
ccaccuugagccuuauuu

SEQ ID NO: 13949 - RNA, 18 nt, artificial
  Chemically synthesized
ccaccaacuuuguaccuu

SEQ ID NO: 13950 - RNA, 18 nt, artificial
  Chemically synthesized
cauacagacucacauaca

SEQ ID NO: 13951 - RNA, 18 nt, artificial
  Chemically synthesized
ccagcugagacuaagaag

SEQ ID NO: 13952 - RNA, 18 nt, artificial
  Chemically synthesized
gcucuacuuaccucucaa

SEQ ID NO: 13953 - RNA, 18 nt, artificial
  Chemically synthesized
ccaucaaguacaaggcaa

SEQ ID NO: 13954 - RNA, 18 nt, artificial
  Chemically synthesized
gaguagcuguguuugaau

SEQ ID NO: 13955 - RNA, 18 nt, artificial
  Chemically synthesized
gcugagacuaagaaggac

SEQ ID NO: 13956 - RNA, 18 nt, artificial
  Chemically synthesized
ccuugauugccuuacaaa

SEQ ID NO: 13957 - RNA, 18 nt, artificial
  Chemically synthesized
agaccaaauuugcacuca

SEQ ID NO: 13958 - RNA, 18 nt, artificial
  Chemically synthesized
accugugucuggucuauu

SEQ ID NO: 13959 - RNA, 18 nt, artificial
  Chemically synthesized
ggaggauugccaaaagua

SEQ ID NO: 13960 - RNA, 18 nt, artificial
  Chemically synthesized
ggcacauacagacucaca

SEQ ID NO: 13961 - RNA, 18 nt, artificial
  Chemically synthesized
gccuguccauguacuucu

SEQ ID NO: 13962 - RNA, 18 nt, artificial
  Chemically synthesized
ccuaauggguccaccucu

SEQ ID NO: 13963 - RNA, 18 nt, artificial
  Chemically synthesized
gugacuuccagaccaaau

SEQ ID NO: 13964 - RNA, 18 nt, artificial
  Chemically synthesized
ccucuaaugaagcacaga

SEQ ID NO: 13965 - RNA, 18 nt, artificial
  Chemically synthesized
ggugguugucucugauga

SEQ ID NO: 13966 - RNA, 18 nt, artificial
  Chemically synthesized
gggaugagucacuguaau

SEQ ID NO: 13967 - RNA, 18 nt, artificial
  Chemically synthesized
caacuuuguaccuugauu

SEQ ID NO: 13968 - RNA, 18 nt, artificial
  Chemically synthesized
ccaacuucacagacacgu

SEQ ID NO: 13969 - RNA, 18 nt, artificial
  Chemically synthesized
gacuuccagaccaaauuu

SEQ ID NO: 13970 - RNA, 18 nt, artificial
  Chemically synthesized
gcacucaucuauuccuuu

SEQ ID NO: 13971 - RNA, 18 nt, artificial
  Chemically synthesized
cacauacagacucacaua

SEQ ID NO: 13972 - RNA, 18 nt, artificial
  Chemically synthesized
gagaaaagccgauauuug

SEQ ID NO: 13973 - RNA, 18 nt, artificial
  Chemically synthesized
ggcacucaucuauuccuu

SEQ ID NO: 13974 - RNA, 18 nt, artificial
  Chemically synthesized
ggacuuugaguacuugga

SEQ ID NO: 13975 - RNA, 18 nt, artificial
  Chemically synthesized
ccucucaauuccuggaga

SEQ ID NO: 13976 - RNA, 18 nt, artificial
  Chemically synthesized
agauggacuuugaguacu

SEQ ID NO: 13977 - RNA, 18 nt, artificial
  Chemically synthesized
ggcacaugggcacauaca

SEQ ID NO: 13978 - RNA, 18 nt, artificial
  Chemically synthesized
cuggucuauugcuaguga

SEQ ID NO: 13979 - RNA, 18 nt, artificial
  Chemically synthesized
gagccuuauuuccuaaug

SEQ ID NO: 13980 - RNA, 18 nt, artificial
  Chemically synthesized
ugagaaaagccgauauuu

SEQ ID NO: 13981 - RNA, 18 nt, artificial
  Chemically synthesized
gccgauauuugccauucu

SEQ ID NO: 13982 - RNA, 18 nt, artificial
  Chemically synthesized
gccggaugguggugguug

SEQ ID NO: 13983 - RNA, 18 nt, artificial
  Chemically synthesized
ccaacuuuguaccuugau

SEQ ID NO: 13984 - RNA, 18 nt, artificial
  Chemically synthesized
gugucuggucuauugcua

SEQ ID NO: 13985 - RNA, 18 nt, artificial
  Chemically synthesized
ggcugugaguggcauguc

SEQ ID NO: 13986 - RNA, 18 nt, artificial
  Chemically synthesized
cccugaagacuguucuga

SEQ ID NO: 13987 - RNA, 18 nt, artificial
  Chemically synthesized
gauggacuuugaguacuu

SEQ ID NO: 13988 - RNA, 18 nt, artificial
  Chemically synthesized
gaggcugagaagccuuua

SEQ ID NO: 13989 - RNA, 18 nt, artificial
  Chemically synthesized
ggaagcgcuggcagacaa

SEQ ID NO: 13990 - RNA, 18 nt, artificial
  Chemically synthesized
cgcuguagacagcagugu

SEQ ID NO: 13991 - RNA, 18 nt, artificial
  Chemically synthesized
gcaccugugucuggucua

SEQ ID NO: 13992 - RNA, 18 nt, artificial
  Chemically synthesized
gggcacucaucuauuccu

SEQ ID NO: 13993 - RNA, 18 nt, artificial
  Chemically synthesized
caaugaacugcagacaca

SEQ ID NO: 13994 - RNA, 18 nt, artificial
  Chemically synthesized
aggcaaugaagaaagagu

SEQ ID NO: 13995 - RNA, 18 nt, artificial
  Chemically synthesized
gaccaaauuugcacucag

SEQ ID NO: 13996 - RNA, 18 nt, artificial
  Chemically synthesized
ccuggcaugagaagggau

SEQ ID NO: 13997 - RNA, 18 nt, artificial
  Chemically synthesized
uccaguuugugcaggaga

SEQ ID NO: 13998 - RNA, 18 nt, artificial
  Chemically synthesized
gagucacuguaaugaugu

SEQ ID NO: 13999 - RNA, 18 nt, artificial
  Chemically synthesized
cugagaaaagccgauauu

SEQ ID NO: 14000 - RNA, 18 nt, artificial
  Chemically synthesized
ggagauccggcaacugga

SEQ ID NO: 14001 - RNA, 18 nt, artificial
  Chemically synthesized
ccuuauuuccuaaugggu

SEQ ID NO: 14002 - RNA, 18 nt, artificial
  Chemically synthesized
cuuauuuccuaauggguc

SEQ ID NO: 14003 - RNA, 18 nt, artificial
  Chemically synthesized
ggcaaugaagaaagaguu

SEQ ID NO: 14004 - RNA, 18 nt, artificial
  Chemically synthesized
cucaguuuccucacuuga

SEQ ID NO: 14005 - RNA, 18 nt, artificial
  Chemically synthesized
ccugaagacuguucugag

SEQ ID NO: 14006 - RNA, 18 nt, artificial
  Chemically synthesized
ggagaugccaacuucaca

SEQ ID NO: 14007 - RNA, 18 nt, artificial
  Chemically synthesized
cuuuaauacugggcauuu

SEQ ID NO: 14008 - RNA, 18 nt, artificial
  Chemically synthesized
ggcggaggagauggacuu

SEQ ID NO: 14009 - RNA, 18 nt, artificial
  Chemically synthesized
cacacguuuuucuaggua

SEQ ID NO: 14010 - RNA, 18 nt, artificial
  Chemically synthesized
acccaauguaccaguauu

SEQ ID NO: 14011 - RNA, 18 nt, artificial
  Chemically synthesized
ugagaagccuuuacaggu

SEQ ID NO: 14012 - RNA, 18 nt, artificial
  Chemically synthesized
guaccaguauuuauaccu

SEQ ID NO: 14013 - RNA, 18 nt, artificial
  Chemically synthesized
ggcagcuucuuccacagu

SEQ ID NO: 14014 - RNA, 18 nt, artificial
  Chemically synthesized
gcuccagauuguagggca

SEQ ID NO: 14015 - RNA, 18 nt, artificial
  Chemically synthesized
acuuugaguacuuggaga

SEQ ID NO: 14016 - RNA, 18 nt, artificial
  Chemically synthesized
ggcaugagaagggauccu

SEQ ID NO: 14017 - RNA, 18 nt, artificial
  Chemically synthesized
ggcaacuggagacacaag

SEQ ID NO: 14018 - RNA, 18 nt, artificial
  Chemically synthesized
aggaaucugugcucuacu

SEQ ID NO: 14019 - RNA, 18 nt, artificial
  Chemically synthesized
ccaggacacuauagaaca

SEQ ID NO: 14020 - RNA, 18 nt, artificial
  Chemically synthesized
agccuuauuuccuaaugg

SEQ ID NO: 14021 - RNA, 18 nt, artificial
  Chemically synthesized
gggagaccaggcuuggcu

SEQ ID NO: 14022 - RNA, 18 nt, artificial
  Chemically synthesized
cauacagacacacacaua

SEQ ID NO: 14023 - RNA, 18 nt, artificial
  Chemically synthesized
ccaucagaagcgacugau

SEQ ID NO: 14024 - RNA, 18 nt, artificial
  Chemically synthesized
ggagaaagaggaagcgcu

SEQ ID NO: 14025 - RNA, 18 nt, artificial
  Chemically synthesized
gugagcucaucgaaaaga

SEQ ID NO: 14026 - RNA, 18 nt, artificial
  Chemically synthesized
cacacauauauguacaga

SEQ ID NO: 14027 - RNA, 18 nt, artificial
  Chemically synthesized
gcaugagaagggauccug

SEQ ID NO: 14028 - RNA, 18 nt, artificial
  Chemically synthesized
gaauauaucuugcauccu

SEQ ID NO: 14029 - RNA, 18 nt, artificial
  Chemically synthesized
ggaagagagcugcuuaaa

SEQ ID NO: 14030 - RNA, 18 nt, artificial
  Chemically synthesized
ccagcgacauccaguuug

SEQ ID NO: 14031 - RNA, 18 nt, artificial
  Chemically synthesized
gagacuaagaaggaccag

SEQ ID NO: 14032 - RNA, 18 nt, artificial
  Chemically synthesized
gcugagaagccuuuacag

SEQ ID NO: 14033 - RNA, 18 nt, artificial
  Chemically synthesized
gccuacugaugcuucagu

SEQ ID NO: 14034 - RNA, 18 nt, artificial
  Chemically synthesized
ccucucaucugcaucuuu

SEQ ID NO: 14035 - RNA, 18 nt, artificial
  Chemically synthesized
caagaggcaucuucuaca

SEQ ID NO: 14036 - RNA, 18 nt, artificial
  Chemically synthesized
cucaauuccuggagaugc

SEQ ID NO: 14037 - RNA, 18 nt, artificial
  Chemically synthesized
gcuggagcaagguaccuu

SEQ ID NO: 14038 - RNA, 18 nt, artificial
  Chemically synthesized
ggacccaauguaccagua

SEQ ID NO: 14039 - RNA, 18 nt, artificial
  Chemically synthesized
aggaaauggugaagcaua

SEQ ID NO: 14040 - RNA, 18 nt, artificial
  Chemically synthesized
cucacauacagacacaca

SEQ ID NO: 14041 - RNA, 18 nt, artificial
  Chemically synthesized
ucaucaaguaugaguucu

SEQ ID NO: 14042 - RNA, 18 nt, artificial
  Chemically synthesized
cucuugugucccuacuca

SEQ ID NO: 14043 - RNA, 18 nt, artificial
  Chemically synthesized
cauucuuccuauauccug

SEQ ID NO: 14044 - RNA, 18 nt, artificial
  Chemically synthesized
ccagagcaauuuauacuu

SEQ ID NO: 14045 - RNA, 18 nt, artificial
  Chemically synthesized
ggagaacagagaguagcu

SEQ ID NO: 14046 - RNA, 18 nt, artificial
  Chemically synthesized
cacauauauguacagaca

SEQ ID NO: 14047 - RNA, 18 nt, artificial
  Chemically synthesized
caaggaaugugacuucca

SEQ ID NO: 14048 - RNA, 18 nt, artificial
  Chemically synthesized
gacaaacuaucgacugaa

SEQ ID NO: 14049 - RNA, 18 nt, artificial
  Chemically synthesized
ucuacuuaccucucaauu

SEQ ID NO: 14050 - RNA, 18 nt, artificial
  Chemically synthesized
gagcaaggaaugugacuu

SEQ ID NO: 14051 - RNA, 18 nt, artificial
  Chemically synthesized
ccagcauugaggaggauu

SEQ ID NO: 14052 - RNA, 18 nt, artificial
  Chemically synthesized
ccuucccagagcaauuua

SEQ ID NO: 14053 - RNA, 18 nt, artificial
  Chemically synthesized
ggaggagauggacuuuga

SEQ ID NO: 14054 - RNA, 18 nt, artificial
  Chemically synthesized
gagccauucacacaucuu

SEQ ID NO: 14055 - RNA, 18 nt, artificial
  Chemically synthesized
ggcggcgcuucucggaaa

SEQ ID NO: 14056 - RNA, 18 nt, artificial
  Chemically synthesized
ccaccugcagagagcuuu

SEQ ID NO: 14057 - RNA, 18 nt, artificial
  Chemically synthesized
ccagcauccugagguuca

SEQ ID NO: 14058 - RNA, 18 nt, artificial
  Chemically synthesized
ggagcugggacccagcau

SEQ ID NO: 14059 - RNA, 18 nt, artificial
  Chemically synthesized
gcucgagcugcuuaccaa

SEQ ID NO: 14060 - RNA, 18 nt, artificial
  Chemically synthesized
cuacuuaccucucaauuc

SEQ ID NO: 14061 - RNA, 18 nt, artificial
  Chemically synthesized
acuggaacagacaaacua

SEQ ID NO: 14062 - RNA, 18 nt, artificial
  Chemically synthesized
gguggugguugucucuga

SEQ ID NO: 14063 - RNA, 18 nt, artificial
  Chemically synthesized
gccgcuguagacagcagu

SEQ ID NO: 14064 - RNA, 18 nt, artificial
  Chemically synthesized
accagcugagacuaagaa

SEQ ID NO: 14065 - RNA, 18 nt, artificial
  Chemically synthesized
cucucugcaugaucuugu

SEQ ID NO: 14066 - RNA, 18 nt, artificial
  Chemically synthesized
gggcaucaccacacuuga

SEQ ID NO: 14067 - RNA, 18 nt, artificial
  Chemically synthesized
gcauuuagcugccaugca

SEQ ID NO: 14068 - RNA, 18 nt, artificial
  Chemically synthesized
ggagaaggugccaugguc

SEQ ID NO: 14069 - RNA, 18 nt, artificial
  Chemically synthesized
gcuucucggaaagcgaaa

SEQ ID NO: 14070 - RNA, 18 nt, artificial
  Chemically synthesized
ccaguuugugcaggagau

SEQ ID NO: 14071 - RNA, 18 nt, artificial
  Chemically synthesized
cuuugaguacuuggagau

SEQ ID NO: 14072 - RNA, 18 nt, artificial
  Chemically synthesized
gcauaucuuugcuccacu

SEQ ID NO: 14073 - RNA, 18 nt, artificial
  Chemically synthesized
caaaaauugggcacucau

SEQ ID NO: 14074 - RNA, 18 nt, artificial
  Chemically synthesized
cuaagaaggaccagcaga

SEQ ID NO: 14075 - RNA, 18 nt, artificial
  Chemically synthesized
ccuucagcagugacaagu

SEQ ID NO: 14076 - RNA, 18 nt, artificial
  Chemically synthesized
cagacacagcuguucucu

SEQ ID NO: 14077 - RNA, 18 nt, artificial
  Chemically synthesized
ggaucuugggagggaaug

SEQ ID NO: 14078 - RNA, 18 nt, artificial
  Chemically synthesized
ggagcaagguaccuuuuc

SEQ ID NO: 14079 - RNA, 18 nt, artificial
  Chemically synthesized
ccuggaauauaucuugca

SEQ ID NO: 14080 - RNA, 18 nt, artificial
  Chemically synthesized
agaacagagaguagcugu

SEQ ID NO: 14081 - RNA, 18 nt, artificial
  Chemically synthesized
ugacuuccagaccaaauu

SEQ ID NO: 14082 - RNA, 18 nt, artificial
  Chemically synthesized
cacucaucuauuccuuuu

SEQ ID NO: 14083 - RNA, 18 nt, artificial
  Chemically synthesized
ggaaccaguggcugugag

SEQ ID NO: 14084 - RNA, 18 nt, artificial
  Chemically synthesized
gcaggaggaggcugagaa

SEQ ID NO: 14085 - RNA, 18 nt, artificial
  Chemically synthesized
gggagagcuggcuguugc

SEQ ID NO: 14086 - RNA, 18 nt, artificial
  Chemically synthesized
caucuucacccucaguuu

SEQ ID NO: 14087 - RNA, 18 nt, artificial
  Chemically synthesized
ccgauauuugccauucuu

SEQ ID NO: 14088 - RNA, 18 nt, artificial
  Chemically synthesized
ccgcgcuggcggaggaga

SEQ ID NO: 14089 - RNA, 18 nt, artificial
  Chemically synthesized
cagagaguagcuguguuu

SEQ ID NO: 14090 - RNA, 18 nt, artificial
  Chemically synthesized
cucuguucuugaacgugc

SEQ ID NO: 14091 - RNA, 18 nt, artificial
  Chemically synthesized
agaggcaucuucuacaug

SEQ ID NO: 14092 - RNA, 18 nt, artificial
  Chemically synthesized
ccaggcuggagcaaggua

SEQ ID NO: 14093 - RNA, 18 nt, artificial
  Chemically synthesized
aggcuuggcugcgggaga

SEQ ID NO: 14094 - RNA, 18 nt, artificial
  Chemically synthesized
gcuguagacagcaguguc

SEQ ID NO: 14095 - RNA, 18 nt, artificial
  Chemically synthesized
uggucuauugcuagugag

SEQ ID NO: 14096 - RNA, 18 nt, artificial
  Chemically synthesized
gcaccaaaucuugguucu

SEQ ID NO: 14097 - RNA, 18 nt, artificial
  Chemically synthesized
gagaagccuuuacaggug

SEQ ID NO: 14098 - RNA, 18 nt, artificial
  Chemically synthesized
cugucucuguucuugaac

SEQ ID NO: 14099 - RNA, 18 nt, artificial
  Chemically synthesized
ugaucuuguugaggcauu

SEQ ID NO: 14100 - RNA, 18 nt, artificial
  Chemically synthesized
cuuccacagugaugccua

SEQ ID NO: 14101 - RNA, 18 nt, artificial
  Chemically synthesized
ugucccuacucauugaaa

SEQ ID NO: 14102 - RNA, 18 nt, artificial
  Chemically synthesized
cugagaagccuuuacagg

SEQ ID NO: 14103 - RNA, 18 nt, artificial
  Chemically synthesized
ggguccaccucucaucug

SEQ ID NO: 14104 - RNA, 18 nt, artificial
  Chemically synthesized
ggaaugugacuuccagac

SEQ ID NO: 14105 - RNA, 18 nt, artificial
  Chemically synthesized
gacacacacauauaugua

SEQ ID NO: 14106 - RNA, 18 nt, artificial
  Chemically synthesized
agaguagcuguguuugaa

SEQ ID NO: 14107 - RNA, 18 nt, artificial
  Chemically synthesized
ugccauucuuccuauauc

SEQ ID NO: 14108 - RNA, 18 nt, artificial
  Chemically synthesized
gcaccagcauacacacgu

SEQ ID NO: 14109 - RNA, 18 nt, artificial
  Chemically synthesized
gacugaaguugugugugu

SEQ ID NO: 14110 - RNA, 18 nt, artificial
  Chemically synthesized
ccacuuucagccaggcug

SEQ ID NO: 14111 - RNA, 18 nt, artificial
  Chemically synthesized
ggaggaggcugagaagcc

SEQ ID NO: 14112 - RNA, 18 nt, artificial
  Chemically synthesized
gcaacuggaacagacaaa

SEQ ID NO: 14113 - RNA, 18 nt, artificial
  Chemically synthesized
cuggaauauaucuugcau

SEQ ID NO: 14114 - RNA, 18 nt, artificial
  Chemically synthesized
cccagagcaauuuauacu

SEQ ID NO: 14115 - RNA, 18 nt, artificial
  Chemically synthesized
ggacaucacauuucaugu

SEQ ID NO: 14116 - RNA, 18 nt, artificial
  Chemically synthesized
caaauuugcacucagccu

SEQ ID NO: 14117 - RNA, 18 nt, artificial
  Chemically synthesized
ugagguucaucacugucu

SEQ ID NO: 14118 - RNA, 18 nt, artificial
  Chemically synthesized
caaugaagaaagaguucc

SEQ ID NO: 14119 - RNA, 18 nt, artificial
  Chemically synthesized
ugagccuuauuuccuaau

SEQ ID NO: 14120 - RNA, 18 nt, artificial
  Chemically synthesized
gacauguacucucacaca

SEQ ID NO: 14121 - RNA, 18 nt, artificial
  Chemically synthesized
gaacagacaaacuaucga

SEQ ID NO: 14122 - RNA, 18 nt, artificial
  Chemically synthesized
augccaacuucacagaca

SEQ ID NO: 14123 - RNA, 18 nt, artificial
  Chemically synthesized
ccaagagacucgccugag

SEQ ID NO: 14124 - RNA, 18 nt, artificial
  Chemically synthesized
gcaacuggagacacaagc

SEQ ID NO: 14125 - RNA, 18 nt, artificial
  Chemically synthesized
gaugagucacuguaauga

SEQ ID NO: 14126 - RNA, 18 nt, artificial
  Chemically synthesized
caccuugagccuuauuuc

SEQ ID NO: 14127 - RNA, 18 nt, artificial
  Chemically synthesized
gagauggacuuugaguac

SEQ ID NO: 14128 - RNA, 18 nt, artificial
  Chemically synthesized
ugcagacacagcuguucu

SEQ ID NO: 14129 - RNA, 18 nt, artificial
  Chemically synthesized
ccuggcugcucucaacau

SEQ ID NO: 14130 - RNA, 18 nt, artificial
  Chemically synthesized
cuggaacagacaaacuau

SEQ ID NO: 14131 - RNA, 18 nt, artificial
  Chemically synthesized
caaguacaaggcaaugaa

SEQ ID NO: 14132 - RNA, 18 nt, artificial
  Chemically synthesized
gacucacauacagacaca

SEQ ID NO: 14133 - RNA, 18 nt, artificial
  Chemically synthesized
agcucagcucugagccau

SEQ ID NO: 14134 - RNA, 18 nt, artificial
  Chemically synthesized
ccuuuaauacugggcauu

SEQ ID NO: 14135 - RNA, 18 nt, artificial
  Chemically synthesized
cucucaauuccuggagau

SEQ ID NO: 14136 - RNA, 18 nt, artificial
  Chemically synthesized
gguaccuuuucuuaggau

SEQ ID NO: 14137 - RNA, 18 nt, artificial
  Chemically synthesized
gagaaggugccauggucu

SEQ ID NO: 14138 - RNA, 18 nt, artificial
  Chemically synthesized
ggcccagcccaaggagac

SEQ ID NO: 14139 - RNA, 18 nt, artificial
  Chemically synthesized
cauguacucucacacaca

SEQ ID NO: 14140 - RNA, 18 nt, artificial
  Chemically synthesized
cgggagagcuggcuguug

SEQ ID NO: 14141 - RNA, 18 nt, artificial
  Chemically synthesized
gacugcucgagcugcuua

SEQ ID NO: 14142 - RNA, 18 nt, artificial
  Chemically synthesized
cgagaccucaaggguaga

SEQ ID NO: 14143 - RNA, 18 nt, artificial
  Chemically synthesized
ugugacuuccagaccaaa

SEQ ID NO: 14144 - RNA, 18 nt, artificial
  Chemically synthesized
uguacagacauguacucu

SEQ ID NO: 14145 - RNA, 18 nt, artificial
  Chemically synthesized
cacacaggcaccagcaua

SEQ ID NO: 14146 - RNA, 18 nt, artificial
  Chemically synthesized
gcguuucgaugccuucau

SEQ ID NO: 14147 - RNA, 18 nt, artificial
  Chemically synthesized
cuggguguguguguaucu

SEQ ID NO: 14148 - RNA, 18 nt, artificial
  Chemically synthesized
guguguguguaucugucu

SEQ ID NO: 14149 - RNA, 18 nt, artificial
  Chemically synthesized
cagacacacacauauaug

SEQ ID NO: 14150 - RNA, 18 nt, artificial
  Chemically synthesized
cacagugaugccuacuga

SEQ ID NO: 14151 - RNA, 18 nt, artificial
  Chemically synthesized
aguuugugcaggagauga

SEQ ID NO: 14152 - RNA, 18 nt, artificial
  Chemically synthesized
ggcugcuuuucauuucca

SEQ ID NO: 14153 - RNA, 18 nt, artificial
  Chemically synthesized
ggucuauugcuagugagc

SEQ ID NO: 14154 - RNA, 18 nt, artificial
  Chemically synthesized
ccagcauacacacguuuu

SEQ ID NO: 14155 - RNA, 18 nt, artificial
  Chemically synthesized
gagaagggauccuggccu

SEQ ID NO: 14156 - RNA, 18 nt, artificial
  Chemically synthesized
gugugugucugaccgcga

SEQ ID NO: 14157 - RNA, 18 nt, artificial
  Chemically synthesized
gcuucuuccacagugaug

SEQ ID NO: 14158 - RNA, 18 nt, artificial
  Chemically synthesized
gagaacagagaguagcug

SEQ ID NO: 14159 - RNA, 18 nt, artificial
  Chemically synthesized
acaacaaugaacugcaga

SEQ ID NO: 14160 - RNA, 18 nt, artificial
  Chemically synthesized
cgagcugcuuaccaagcu

SEQ ID NO: 14161 - RNA, 18 nt, artificial
  Chemically synthesized
aaaucuugguucuggacu

SEQ ID NO: 14162 - RNA, 18 nt, artificial
  Chemically synthesized
gagagcugcuuaaacuca

SEQ ID NO: 14163 - RNA, 18 nt, artificial
  Chemically synthesized
cugcuuaaacucacacaa

SEQ ID NO: 14164 - RNA, 18 nt, artificial
  Chemically synthesized
ugcccaaccuucagcagu

SEQ ID NO: 14165 - RNA, 18 nt, artificial
  Chemically synthesized
cgcccuggcgccucugua

SEQ ID NO: 14166 - RNA, 18 nt, artificial
  Chemically synthesized
gcauggaaccaguggcug

SEQ ID NO: 14167 - RNA, 18 nt, artificial
  Chemically synthesized
gcauccugagguucauca

SEQ ID NO: 14168 - RNA, 18 nt, artificial
  Chemically synthesized
cuggcaugagaagggauc

SEQ ID NO: 14169 - RNA, 18 nt, artificial
  Chemically synthesized
gcgaccauauaaaagccu

SEQ ID NO: 14170 - RNA, 18 nt, artificial
  Chemically synthesized
gaaaccaaacucuggaaa

SEQ ID NO: 14171 - RNA, 18 nt, artificial
  Chemically synthesized
gcagcuggacaucacauu

SEQ ID NO: 14172 - RNA, 18 nt, artificial
  Chemically synthesized
cucuacuuaccucucaau

SEQ ID NO: 14173 - RNA, 18 nt, artificial
  Chemically synthesized
cacauacagacacacaca

SEQ ID NO: 14174 - RNA, 18 nt, artificial
  Chemically synthesized
gcauaugccugagcguuu

SEQ ID NO: 14175 - RNA, 18 nt, artificial
  Chemically synthesized
agcuguguuugaaucccu

SEQ ID NO: 14176 - RNA, 18 nt, artificial
  Chemically synthesized
gccuuauuuccuaauggg

SEQ ID NO: 14177 - RNA, 18 nt, artificial
  Chemically synthesized
agauccggcaacuggaga

SEQ ID NO: 14178 - RNA, 18 nt, artificial
  Chemically synthesized
cagacucacauacagaca

SEQ ID NO: 14179 - RNA, 18 nt, artificial
  Chemically synthesized
cagccaggcuggagcaag

SEQ ID NO: 14180 - RNA, 18 nt, artificial
  Chemically synthesized
uacagacucacauacaga

SEQ ID NO: 14181 - RNA, 18 nt, artificial
  Chemically synthesized
gucugcgacuacaccaac

SEQ ID NO: 14182 - RNA, 18 nt, artificial
  Chemically synthesized
gucccuacucauugaaac

SEQ ID NO: 14183 - RNA, 18 nt, artificial
  Chemically synthesized
gaagagagcugcuuaaac

SEQ ID NO: 14184 - RNA, 18 nt, artificial
  Chemically synthesized
cccuggguguguguguau

SEQ ID NO: 14185 - RNA, 18 nt, artificial
  Chemically synthesized
cacagagagaggaagaga

SEQ ID NO: 14186 - RNA, 18 nt, artificial
  Chemically synthesized
gcggaggagauggacuuu

SEQ ID NO: 14187 - RNA, 18 nt, artificial
  Chemically synthesized
gucccugaacaaaaauug

SEQ ID NO: 14188 - RNA, 18 nt, artificial
  Chemically synthesized
cagacauguacucucaca

SEQ ID NO: 14189 - RNA, 18 nt, artificial
  Chemically synthesized
ccacuugcuggauuauca

SEQ ID NO: 14190 - RNA, 18 nt, artificial
  Chemically synthesized
ugcccugccuccuccuuu

SEQ ID NO: 14191 - RNA, 18 nt, artificial
  Chemically synthesized
cacauuucauguccugca

SEQ ID NO: 14192 - RNA, 18 nt, artificial
  Chemically synthesized
accuggcaugagaaggga

SEQ ID NO: 14193 - RNA, 18 nt, artificial
  Chemically synthesized
cccagcgacauccaguuu

SEQ ID NO: 14194 - RNA, 18 nt, artificial
  Chemically synthesized
ggacacuauagaacagga

SEQ ID NO: 14195 - RNA, 18 nt, artificial
  Chemically synthesized
gagggagccuaaccaugu

SEQ ID NO: 14196 - RNA, 18 nt, artificial
  Chemically synthesized
cuguggucaugcucucag

SEQ ID NO: 14197 - RNA, 18 nt, artificial
  Chemically synthesized
gaacaaaaauugggcacu

SEQ ID NO: 14198 - RNA, 18 nt, artificial
  Chemically synthesized
uguucuugaacgugcgga

SEQ ID NO: 14199 - RNA, 18 nt, artificial
  Chemically synthesized
cgacauccaguuugugca

SEQ ID NO: 14200 - RNA, 18 nt, artificial
  Chemically synthesized
gcugcucucaacaugcga

SEQ ID NO: 14201 - RNA, 18 nt, artificial
  Chemically synthesized
agccgauauuugccauuc

SEQ ID NO: 14202 - RNA, 18 nt, artificial
  Chemically synthesized
uggcauauucaucaagua

SEQ ID NO: 14203 - RNA, 18 nt, artificial
  Chemically synthesized
agcuucuuccacagugau

SEQ ID NO: 14204 - RNA, 18 nt, artificial
  Chemically synthesized
ggagaugauccggcaacu

SEQ ID NO: 14205 - RNA, 18 nt, artificial
  Chemically synthesized
auugggcacucaucuauu

SEQ ID NO: 14206 - RNA, 18 nt, artificial
  Chemically synthesized
ccaccuggcaugagaagg

SEQ ID NO: 14207 - RNA, 18 nt, artificial
  Chemically synthesized
agcuuucccaccaacuuu

SEQ ID NO: 14208 - RNA, 18 nt, artificial
  Chemically synthesized
gucccugcccugaagacu

SEQ ID NO: 14209 - RNA, 18 nt, artificial
  Chemically synthesized
ggccucuggcauauucau

SEQ ID NO: 14210 - RNA, 18 nt, artificial
  Chemically synthesized
gugguugucucugaugau

SEQ ID NO: 14211 - RNA, 18 nt, artificial
  Chemically synthesized
aggauugccaaaaguaua

SEQ ID NO: 14212 - RNA, 18 nt, artificial
  Chemically synthesized
ggaccagcagagccagcu

SEQ ID NO: 14213 - RNA, 18 nt, artificial
  Chemically synthesized
gcuggacaucacauuuca

SEQ ID NO: 14214 - RNA, 18 nt, artificial
  Chemically synthesized
uccuggagaugccaacuu

SEQ ID NO: 14215 - RNA, 18 nt, artificial
  Chemically synthesized
cucuggcauauucaucaa

SEQ ID NO: 14216 - RNA, 18 nt, artificial
  Chemically synthesized
acuggagacacaagcgga

SEQ ID NO: 14217 - RNA, 18 nt, artificial
  Chemically synthesized
guuucgaugccuucaucu

SEQ ID NO: 14218 - RNA, 18 nt, artificial
  Chemically synthesized
ccucaaggguagaggugg

SEQ ID NO: 14219 - RNA, 18 nt, artificial
  Chemically synthesized
cauacacacguuuuucua

SEQ ID NO: 14220 - RNA, 18 nt, artificial
  Chemically synthesized
cccaccuugagccuuauu

SEQ ID NO: 14221 - RNA, 18 nt, artificial
  Chemically synthesized
cgauauuugccauucuuc

SEQ ID NO: 14222 - RNA, 18 nt, artificial
  Chemically synthesized
gagcuuucccaccaacuu

SEQ ID NO: 14223 - RNA, 18 nt, artificial
  Chemically synthesized
cucggaaagcgaaagccg

SEQ ID NO: 14224 - RNA, 18 nt, artificial
  Chemically synthesized
gccucgagaccucaaggg

SEQ ID NO: 14225 - RNA, 18 nt, artificial
  Chemically synthesized
agagagcuuucccaccaa

SEQ ID NO: 14226 - RNA, 18 nt, artificial
  Chemically synthesized
gacuaagaaggaccagca

SEQ ID NO: 14227 - RNA, 18 nt, artificial
  Chemically synthesized
cauuccacuuccuccuuc

SEQ ID NO: 14228 - RNA, 18 nt, artificial
  Chemically synthesized
caaacuaucgacugaagu

SEQ ID NO: 14229 - RNA, 18 nt, artificial
  Chemically synthesized
gccuucaucugcuauugc

SEQ ID NO: 14230 - RNA, 18 nt, artificial
  Chemically synthesized
aucugagaaaagccgaua

SEQ ID NO: 14231 - RNA, 18 nt, artificial
  Chemically synthesized
gaggcauuuagcugccau

SEQ ID NO: 14232 - RNA, 18 nt, artificial
  Chemically synthesized
aggaccagcugagacuaa

SEQ ID NO: 14233 - RNA, 18 nt, artificial
  Chemically synthesized
ggugaagcauagcucugg

SEQ ID NO: 14234 - RNA, 18 nt, artificial
  Chemically synthesized
cccuggcugcucucaaca

SEQ ID NO: 14235 - RNA, 18 nt, artificial
  Chemically synthesized
cauugaaaccaaacucug

SEQ ID NO: 14236 - RNA, 18 nt, artificial
  Chemically synthesized
gaggaaucugugcucuac

SEQ ID NO: 14237 - RNA, 18 nt, artificial
  Chemically synthesized
gcucagcucugagccauu

SEQ ID NO: 14238 - RNA, 18 nt, artificial
  Chemically synthesized
agccaucucaagaggcau

SEQ ID NO: 14239 - RNA, 18 nt, artificial
  Chemically synthesized
ggauugccaaaaguauau

SEQ ID NO: 14240 - RNA, 18 nt, artificial
  Chemically synthesized
cguuuuucuagguacagc

SEQ ID NO: 14241 - RNA, 18 nt, artificial
  Chemically synthesized
ugcccugaagacuguucu

SEQ ID NO: 14242 - RNA, 18 nt, artificial
  Chemically synthesized
ucuaaugaagcacagaga

SEQ ID NO: 14243 - RNA, 18 nt, artificial
  Chemically synthesized
cgcuggcagacaaugcga

SEQ ID NO: 14244 - RNA, 18 nt, artificial
  Chemically synthesized
cucaagaggcaucuucua

SEQ ID NO: 14245 - RNA, 18 nt, artificial
  Chemically synthesized
guuugugcaggagaugau

SEQ ID NO: 14246 - RNA, 18 nt, artificial
  Chemically synthesized
gaguacuuggagauccgg

SEQ ID NO: 14247 - RNA, 18 nt, artificial
  Chemically synthesized
gcccugggugugugugua

SEQ ID NO: 14248 - RNA, 18 nt, artificial
  Chemically synthesized
uggucaugcucucagcuc

SEQ ID NO: 14249 - RNA, 18 nt, artificial
  Chemically synthesized
gcagagcaaggaauguga

SEQ ID NO: 14250 - RNA, 18 nt, artificial
  Chemically synthesized
cccuuuaauacugggcau

SEQ ID NO: 14251 - RNA, 18 nt, artificial
  Chemically synthesized
cucacacaacaaugaacu

SEQ ID NO: 14252 - RNA, 18 nt, artificial
  Chemically synthesized
cucucaacaugcgagugc

SEQ ID NO: 14253 - RNA, 18 nt, artificial
  Chemically synthesized
cucugaugauuaccugca

SEQ ID NO: 14254 - RNA, 18 nt, artificial
  Chemically synthesized
ggucuuaggugucugugc

SEQ ID NO: 14255 - RNA, 18 nt, artificial
  Chemically synthesized
cuggagaugccaacuuca

SEQ ID NO: 14256 - RNA, 18 nt, artificial
  Chemically synthesized
ggaaaggacccaauguac

SEQ ID NO: 14257 - RNA, 18 nt, artificial
  Chemically synthesized
acacaacaaugaacugca

SEQ ID NO: 14258 - RNA, 18 nt, artificial
  Chemically synthesized
gcaaugaagaaagaguuc

SEQ ID NO: 14259 - RNA, 18 nt, artificial
  Chemically synthesized
cagcuucuuccacaguga

SEQ ID NO: 14260 - RNA, 18 nt, artificial
  Chemically synthesized
cauauauguacagacaug

SEQ ID NO: 14261 - RNA, 18 nt, artificial
  Chemically synthesized
caagguaccuuuucuuag

SEQ ID NO: 14262 - RNA, 18 nt, artificial
  Chemically synthesized
cugugucuggucuauugc

SEQ ID NO: 14263 - RNA, 18 nt, artificial
  Chemically synthesized
cacaugggcacauacaga

SEQ ID NO: 14264 - RNA, 18 nt, artificial
  Chemically synthesized
augagucacuguaaugau

SEQ ID NO: 14265 - RNA, 18 nt, artificial
  Chemically synthesized
gcaagguaccuuuucuua

SEQ ID NO: 14266 - RNA, 18 nt, artificial
  Chemically synthesized
cugugaguggcaugucca

SEQ ID NO: 14267 - RNA, 18 nt, artificial
  Chemically synthesized
guucaucacugucugcga

SEQ ID NO: 14268 - RNA, 18 nt, artificial
  Chemically synthesized
cuugugucccuacucauu

SEQ ID NO: 14269 - RNA, 18 nt, artificial
  Chemically synthesized
gcuguugcuggacuacau

SEQ ID NO: 14270 - RNA, 18 nt, artificial
  Chemically synthesized
gaggaggcugagaagccu

SEQ ID NO: 14271 - RNA, 18 nt, artificial
  Chemically synthesized
ccaaauuugcacucagcc

SEQ ID NO: 14272 - RNA, 18 nt, artificial
  Chemically synthesized
agacacagcuguucucuc

SEQ ID NO: 14273 - RNA, 18 nt, artificial
  Chemically synthesized
ggcauuuuaaagccaucu

SEQ ID NO: 14274 - RNA, 18 nt, artificial
  Chemically synthesized
ugucccugaacaaaaauu

SEQ ID NO: 14275 - RNA, 18 nt, artificial
  Chemically synthesized
ccauucuuccuauauccu

SEQ ID NO: 14276 - RNA, 18 nt, artificial
  Chemically synthesized
aaggcaaugaagaaagag

SEQ ID NO: 14277 - RNA, 18 nt, artificial
  Chemically synthesized
cgggugccgcaggagaaa

SEQ ID NO: 14278 - RNA, 18 nt, artificial
  Chemically synthesized
acuuccagaccaaauuug

SEQ ID NO: 14279 - RNA, 18 nt, artificial
  Chemically synthesized
cgcccauuccacuuccuc

SEQ ID NO: 14280 - RNA, 18 nt, artificial
  Chemically synthesized
ccugugucuggucuauug

SEQ ID NO: 14281 - RNA, 18 nt, artificial
  Chemically synthesized
cuuuguaccuugauugcc

SEQ ID NO: 14282 - RNA, 18 nt, artificial
  Chemically synthesized
ggcauaugccugagcguu

SEQ ID NO: 14283 - RNA, 18 nt, artificial
  Chemically synthesized
cccucucugcaugaucuu

SEQ ID NO: 14284 - RNA, 18 nt, artificial
  Chemically synthesized
gaagcauagcucuggguc

SEQ ID NO: 14285 - RNA, 18 nt, artificial
  Chemically synthesized
ucugcaugaucuuguuga

SEQ ID NO: 14286 - RNA, 18 nt, artificial
  Chemically synthesized
caguuuggcccagcccaa

SEQ ID NO: 14287 - RNA, 18 nt, artificial
  Chemically synthesized
uggaaaggacccaaugua

SEQ ID NO: 14288 - RNA, 18 nt, artificial
  Chemically synthesized
gccauucacacaucuuca

SEQ ID NO: 14289 - RNA, 18 nt, artificial
  Chemically synthesized
cagugaugccuacugaug

SEQ ID NO: 14290 - RNA, 18 nt, artificial
  Chemically synthesized
cuacucauugaaaccaaa

SEQ ID NO: 14291 - RNA, 18 nt, artificial
  Chemically synthesized
uacaaggcaaugaagaaa

SEQ ID NO: 14292 - RNA, 18 nt, artificial
  Chemically synthesized
ugaggaggauugccaaaa

SEQ ID NO: 14293 - RNA, 18 nt, artificial
  Chemically synthesized
ugccuguggucaugcucu

SEQ ID NO: 14294 - RNA, 18 nt, artificial
  Chemically synthesized
uggaauauaucuugcauc

SEQ ID NO: 14295 - RNA, 18 nt, artificial
  Chemically synthesized
aggaaugugacuuccaga

SEQ ID NO: 14296 - RNA, 18 nt, artificial
  Chemically synthesized
ggcuggagcaagguaccu

SEQ ID NO: 14297 - RNA, 18 nt, artificial
  Chemically synthesized
ccauggucuuaggugucu

SEQ ID NO: 14298 - RNA, 18 nt, artificial
  Chemically synthesized
cugaaguugugugugucu

SEQ ID NO: 14299 - RNA, 18 nt, artificial
  Chemically synthesized
gcacucagccucucucca

SEQ ID NO: 14300 - RNA, 18 nt, artificial
  Chemically synthesized
gccuuacaaaguuauuug

SEQ ID NO: 14301 - RNA, 18 nt, artificial
  Chemically synthesized
agcucugagccauucaca

SEQ ID NO: 14302 - RNA, 18 nt, artificial
  Chemically synthesized
gugaguggcauguccacu

SEQ ID NO: 14303 - RNA, 18 nt, artificial
  Chemically synthesized
caaggguagaggugggca

SEQ ID NO: 14304 - RNA, 18 nt, artificial
  Chemically synthesized
cgacugaaguugugugug

SEQ ID NO: 14305 - RNA, 18 nt, artificial
  Chemically synthesized
gcccagcccaaggagacc

SEQ ID NO: 14306 - RNA, 18 nt, artificial
  Chemically synthesized
gcccauuccacuuccucc

SEQ ID NO: 14307 - RNA, 18 nt, artificial
  Chemically synthesized
cacacaucuucacccuca

SEQ ID NO: 14308 - RNA, 18 nt, artificial
  Chemically synthesized
ccaaaucuugguucugga

SEQ ID NO: 14309 - RNA, 18 nt, artificial
  Chemically synthesized
acaucuucacccucaguu

SEQ ID NO: 14310 - RNA, 18 nt, artificial
  Chemically synthesized
cagcuucugcccaaccuu

SEQ ID NO: 14311 - RNA, 18 nt, artificial
  Chemically synthesized
gcuguucucucccucucu

SEQ ID NO: 14312 - RNA, 18 nt, artificial
  Chemically synthesized
ccuggguguguguguauc

SEQ ID NO: 14313 - RNA, 18 nt, artificial
  Chemically synthesized
cucaucuauuccuuuucu

SEQ ID NO: 14314 - RNA, 18 nt, artificial
  Chemically synthesized
ccgccugucucuguucuu

SEQ ID NO: 14315 - RNA, 18 nt, artificial
  Chemically synthesized
cuacauguuuuguacgca

SEQ ID NO: 14316 - RNA, 18 nt, artificial
  Chemically synthesized
caguggcugugaguggca

SEQ ID NO: 14317 - RNA, 18 nt, artificial
  Chemically synthesized
ucaucugcaucuuucaca

SEQ ID NO: 14318 - RNA, 18 nt, artificial
  Chemically synthesized
agcucaucgaaaagaggu

SEQ ID NO: 14319 - RNA, 18 nt, artificial
  Chemically synthesized
cguuguaggaggaaucug

SEQ ID NO: 14320 - RNA, 18 nt, artificial
  Chemically synthesized
gauuccuacuucuuacgc

SEQ ID NO: 14321 - RNA, 18 nt, artificial
  Chemically synthesized
auaucuuugcuccacuuu

SEQ ID NO: 14322 - RNA, 18 nt, artificial
  Chemically synthesized
ccauuccacuuccuccuu

SEQ ID NO: 14323 - RNA, 18 nt, artificial
  Chemically synthesized
caccugugucuggucuau

SEQ ID NO: 14324 - RNA, 18 nt, artificial
  Chemically synthesized
guguuugaaucccuguag

SEQ ID NO: 14325 - RNA, 18 nt, artificial
  Chemically synthesized
cacccucaguuuccucac

SEQ ID NO: 14326 - RNA, 18 nt, artificial
  Chemically synthesized
gaacaggaccagcugaga

SEQ ID NO: 14327 - RNA, 18 nt, artificial
  Chemically synthesized
ccuugucccugcccugaa

SEQ ID NO: 14328 - RNA, 18 nt, artificial
  Chemically synthesized
caucuauuccuuuucucu

SEQ ID NO: 14329 - RNA, 18 nt, artificial
  Chemically synthesized
aaucugugcucuacuuac

SEQ ID NO: 14330 - RNA, 18 nt, artificial
  Chemically synthesized
cugugcucuacuuaccuc

SEQ ID NO: 14331 - RNA, 18 nt, artificial
  Chemically synthesized
aggaggcugagaagccuu

SEQ ID NO: 14332 - RNA, 18 nt, artificial
  Chemically synthesized
aaguauaucuugaagcag

SEQ ID NO: 14333 - RNA, 18 nt, artificial
  Chemically synthesized
cucugcacaccgcccauu

SEQ ID NO: 14334 - RNA, 18 nt, artificial
  Chemically synthesized
ggugccgcaggagaaaga

SEQ ID NO: 14335 - RNA, 18 nt, artificial
  Chemically synthesized
cagccucucuccaggugc

SEQ ID NO: 14336 - RNA, 18 nt, artificial
  Chemically synthesized
ugaacugcagacacagcu

SEQ ID NO: 14337 - RNA, 18 nt, artificial
  Chemically synthesized
cuugauugccuuacaaag

SEQ ID NO: 14338 - RNA, 18 nt, artificial
  Chemically synthesized
caggagaugauccggcaa

SEQ ID NO: 14339 - RNA, 18 nt, artificial
  Chemically synthesized
ucaguuuccucacuugag

SEQ ID NO: 14340 - RNA, 18 nt, artificial
  Chemically synthesized
auauguacagacauguac

SEQ ID NO: 14341 - RNA, 18 nt, artificial
  Chemically synthesized
ccaucucaagaggcaucu

SEQ ID NO: 14342 - RNA, 18 nt, artificial
  Chemically synthesized
cagcuguucucucccucu

SEQ ID NO: 14343 - RNA, 18 nt, artificial
  Chemically synthesized
cagcuggacaucacauuu

SEQ ID NO: 14344 - RNA, 18 nt, artificial
  Chemically synthesized
aggagaaagaggaagcgc

SEQ ID NO: 14345 - RNA, 18 nt, artificial
  Chemically synthesized
caugggcacauacagacu

SEQ ID NO: 14346 - RNA, 18 nt, artificial
  Chemically synthesized
ccugcauggaaccagugg

SEQ ID NO: 14347 - RNA, 18 nt, artificial
  Chemically synthesized
cauuucauguccugcaug

SEQ ID NO: 14348 - RNA, 18 nt, artificial
  Chemically synthesized
ccacugcugugaccacga

SEQ ID NO: 14349 - RNA, 18 nt, artificial
  Chemically synthesized
ggcaucaccacacuugau

SEQ ID NO: 14350 - RNA, 18 nt, artificial
  Chemically synthesized
cucuggaaaggacccaau

SEQ ID NO: 14351 - RNA, 18 nt, artificial
  Chemically synthesized
ccgccucgagaccucaag

SEQ ID NO: 14352 - RNA, 18 nt, artificial
  Chemically synthesized
cacacacauauauguaca

SEQ ID NO: 14353 - RNA, 18 nt, artificial
  Chemically synthesized
cccaagagacucgccuga

SEQ ID NO: 14354 - RNA, 18 nt, artificial
  Chemically synthesized
cuuaaacucacacaacaa

SEQ ID NO: 14355 - RNA, 18 nt, artificial
  Chemically synthesized
gaacgugcggacacaggu

SEQ ID NO: 14356 - RNA, 18 nt, artificial
  Chemically synthesized
aggagaugauccggcaac

SEQ ID NO: 14357 - RNA, 18 nt, artificial
  Chemically synthesized
uaaugaagcacagagaga

SEQ ID NO: 14358 - RNA, 18 nt, artificial
  Chemically synthesized
ggagaccaggcuuggcug

SEQ ID NO: 14359 - RNA, 18 nt, artificial
  Chemically synthesized
ucuugcauccugaguuua

SEQ ID NO: 14360 - RNA, 18 nt, artificial
  Chemically synthesized
ccagcuucugcccaaccu

SEQ ID NO: 14361 - RNA, 18 nt, artificial
  Chemically synthesized
cuccuuucguuguaggag

SEQ ID NO: 14362 - RNA, 18 nt, artificial
  Chemically synthesized
cccucucuccuucccaga

SEQ ID NO: 14363 - RNA, 18 nt, artificial
  Chemically synthesized
ucuccuucccagagcaau

SEQ ID NO: 14364 - RNA, 18 nt, artificial
  Chemically synthesized
gagccagcucagcucuga

SEQ ID NO: 14365 - RNA, 18 nt, artificial
  Chemically synthesized
cacucagccucucuccag

SEQ ID NO: 14366 - RNA, 18 nt, artificial
  Chemically synthesized
gcuucugcccaaccuuca

SEQ ID NO: 14367 - RNA, 18 nt, artificial
  Chemically synthesized
gucuggucuauugcuagu

SEQ ID NO: 14368 - RNA, 18 nt, artificial
  Chemically synthesized
agaccucaaggguagagg

SEQ ID NO: 14369 - RNA, 18 nt, artificial
  Chemically synthesized
cucccucucuccuuccca

SEQ ID NO: 14370 - RNA, 18 nt, artificial
  Chemically synthesized
cuccaccuggcaugagaa

SEQ ID NO: 14371 - RNA, 18 nt, artificial
  Chemically synthesized
ggugcccaucagaagcga

SEQ ID NO: 14372 - RNA, 18 nt, artificial
  Chemically synthesized
caugucccugaacaaaaa

SEQ ID NO: 14373 - RNA, 18 nt, artificial
  Chemically synthesized
aggcaucuucuacauguu

SEQ ID NO: 14374 - RNA, 18 nt, artificial
  Chemically synthesized
cucccagcuucugcccaa

SEQ ID NO: 14375 - RNA, 18 nt, artificial
  Chemically synthesized
gccugagcagcuugggcu

SEQ ID NO: 14376 - RNA, 18 nt, artificial
  Chemically synthesized
gagccuuccucccugggc

SEQ ID NO: 14377 - RNA, 18 nt, artificial
  Chemically synthesized
ccuacugaugcuucagug

SEQ ID NO: 14378 - RNA, 18 nt, artificial
  Chemically synthesized
agccaggacacuauagaa

SEQ ID NO: 14379 - RNA, 18 nt, artificial
  Chemically synthesized
cagggagccuuccucccu

SEQ ID NO: 14380 - RNA, 18 nt, artificial
  Chemically synthesized
cuggagcaagguaccuuu

SEQ ID NO: 14381 - RNA, 18 nt, artificial
  Chemically synthesized
gguguguguguaucuguc

SEQ ID NO: 14382 - RNA, 18 nt, artificial
  Chemically synthesized
accaaacucuggaaagga

SEQ ID NO: 14383 - RNA, 18 nt, artificial
  Chemically synthesized
gagcaagguaccuuuucu

SEQ ID NO: 14384 - RNA, 18 nt, artificial
  Chemically synthesized
gcaggcugcuggacgccu

SEQ ID NO: 14385 - RNA, 18 nt, artificial
  Chemically synthesized
gugccauggucuuaggug

SEQ ID NO: 14386 - RNA, 18 nt, artificial
  Chemically synthesized
agguggccgcuguagaca

SEQ ID NO: 14387 - RNA, 18 nt, artificial
  Chemically synthesized
cuauugcuagugagcuca

SEQ ID NO: 14388 - RNA, 18 nt, artificial
  Chemically synthesized
gccgccugucucuguucu

SEQ ID NO: 14389 - RNA, 18 nt, artificial
  Chemically synthesized
gggcauaugccugagcgu

SEQ ID NO: 14390 - RNA, 18 nt, artificial
  Chemically synthesized
cgaccauauaaaagccuc

SEQ ID NO: 14391 - RNA, 18 nt, artificial
  Chemically synthesized
cccgccucgagaccucaa

SEQ ID NO: 14392 - RNA, 18 nt, artificial
  Chemically synthesized
caggcuggagcaagguac

SEQ ID NO: 14393 - RNA, 18 nt, artificial
  Chemically synthesized
ucugcaucuuucacaccu

SEQ ID NO: 14394 - RNA, 18 nt, artificial
  Chemically synthesized
cgcaggagaaagaggaag

SEQ ID NO: 14395 - RNA, 18 nt, artificial
  Chemically synthesized
cuggcugcucucaacaug

SEQ ID NO: 14396 - RNA, 18 nt, artificial
  Chemically synthesized
aacuucacagacacgucu

SEQ ID NO: 14397 - RNA, 18 nt, artificial
  Chemically synthesized
acagacacacacauauau

SEQ ID NO: 14398 - RNA, 18 nt, artificial
  Chemically synthesized
uggacuacaugcuggcca

SEQ ID NO: 14399 - RNA, 18 nt, artificial
  Chemically synthesized
ucuugugucccuacucau

SEQ ID NO: 14400 - RNA, 18 nt, artificial
  Chemically synthesized
cugaugauuaccugcaga

SEQ ID NO: 14401 - RNA, 18 nt, artificial
  Chemically synthesized
cugcagacacagcuguuc

SEQ ID NO: 14402 - RNA, 18 nt, artificial
  Chemically synthesized
uacagacacacacauaua

SEQ ID NO: 14403 - RNA, 18 nt, artificial
  Chemically synthesized
agauaucugagaaaagcc

SEQ ID NO: 14404 - RNA, 18 nt, artificial
  Chemically synthesized
cccugaacaaaaauuggg

SEQ ID NO: 14405 - RNA, 18 nt, artificial
  Chemically synthesized
uaccucuaaugaagcaca

SEQ ID NO: 14406 - RNA, 18 nt, artificial
  Chemically synthesized
gucucuguucuugaacgu

SEQ ID NO: 14407 - RNA, 18 nt, artificial
  Chemically synthesized
caucaaguaugaguucug

SEQ ID NO: 14408 - RNA, 18 nt, artificial
  Chemically synthesized
ucauugaaaccaaacucu

SEQ ID NO: 14409 - RNA, 18 nt, artificial
  Chemically synthesized
cccucaggcuguccucug

SEQ ID NO: 14410 - RNA, 18 nt, artificial
  Chemically synthesized
ugugcucuacuuaccucu

SEQ ID NO: 14411 - RNA, 18 nt, artificial
  Chemically synthesized
gaugccuucaucugcuau

SEQ ID NO: 14412 - RNA, 18 nt, artificial
  Chemically synthesized
gccugagcguuucgaugc

SEQ ID NO: 14413 - RNA, 18 nt, artificial
  Chemically synthesized
agagcaaggaaugugacu

SEQ ID NO: 14414 - RNA, 18 nt, artificial
  Chemically synthesized
uugaguacuuggagaucc

SEQ ID NO: 14415 - RNA, 18 nt, artificial
  Chemically synthesized
aucuuguugaggcauuua

SEQ ID NO: 14416 - RNA, 18 nt, artificial
  Chemically synthesized
uuacaaacagcgaccaua

SEQ ID NO: 14417 - RNA, 18 nt, artificial
  Chemically synthesized
gaaggaccagcagagcca

SEQ ID NO: 14418 - RNA, 18 nt, artificial
  Chemically synthesized
gaaccaguggcugugagu

SEQ ID NO: 14419 - RNA, 18 nt, artificial
  Chemically synthesized
gguggccgcuguagacag

SEQ ID NO: 14420 - RNA, 18 nt, artificial
  Chemically synthesized
ugggcacaugggcacaua

SEQ ID NO: 14421 - RNA, 18 nt, artificial
  Chemically synthesized
gaaguugugugugucuga

SEQ ID NO: 14422 - RNA, 18 nt, artificial
  Chemically synthesized
gcagacaaugcgacccga

SEQ ID NO: 14423 - RNA, 18 nt, artificial
  Chemically synthesized
cuucuacauguuuuguac

SEQ ID NO: 14424 - RNA, 18 nt, artificial
  Chemically synthesized
ggguagaggugggcaccc

SEQ ID NO: 14425 - RNA, 18 nt, artificial
  Chemically synthesized
augccuucaucugcuauu

SEQ ID NO: 14426 - RNA, 18 nt, artificial
  Chemically synthesized
uggcggaggagauggacu

SEQ ID NO: 14427 - RNA, 18 nt, artificial
  Chemically synthesized
ccagaccaaauuugcacu

SEQ ID NO: 14428 - RNA, 18 nt, artificial
  Chemically synthesized
gccucugcacaccgccca

SEQ ID NO: 14429 - RNA, 18 nt, artificial
  Chemically synthesized
caccaaaucuugguucug

SEQ ID NO: 14430 - RNA, 18 nt, artificial
  Chemically synthesized
aacucacacaacaaugaa

SEQ ID NO: 14431 - RNA, 18 nt, artificial
  Chemically synthesized
gcgggagagcuggcuguu

SEQ ID NO: 14432 - RNA, 18 nt, artificial
  Chemically synthesized
ggagagcuggcuguugcu

SEQ ID NO: 14433 - RNA, 18 nt, artificial
  Chemically synthesized
uaccaguauuuauaccuc

SEQ ID NO: 14434 - RNA, 18 nt, artificial
  Chemically synthesized
cuuucagccaggcuggag

SEQ ID NO: 14435 - RNA, 18 nt, artificial
  Chemically synthesized
cgcgcuggcggaggagau

SEQ ID NO: 14436 - RNA, 18 nt, artificial
  Chemically synthesized
gagagcuggcuguugcug

SEQ ID NO: 14437 - RNA, 18 nt, artificial
  Chemically synthesized
auaucugagaaaagccga

SEQ ID NO: 14438 - RNA, 18 nt, artificial
  Chemically synthesized
ugagacuaagaaggacca

SEQ ID NO: 14439 - RNA, 18 nt, artificial
  Chemically synthesized
ggaaagucccaucacuga

SEQ ID NO: 14440 - RNA, 18 nt, artificial
  Chemically synthesized
gagaccucaaggguagag

SEQ ID NO: 14441 - RNA, 18 nt, artificial
  Chemically synthesized
cugcaucuuucacaccuc

SEQ ID NO: 14442 - RNA, 18 nt, artificial
  Chemically synthesized
cacuauagaacaggacca

SEQ ID NO: 14443 - RNA, 18 nt, artificial
  Chemically synthesized
gacucgccugagcagcuu

SEQ ID NO: 14444 - RNA, 18 nt, artificial
  Chemically synthesized
guuuuucuagguacagcu

SEQ ID NO: 14445 - RNA, 18 nt, artificial
  Chemically synthesized
cuggcaggcugcuggacg

SEQ ID NO: 14446 - RNA, 18 nt, artificial
  Chemically synthesized
uggcccagcccaaggaga

SEQ ID NO: 14447 - RNA, 18 nt, artificial
  Chemically synthesized
ggagccuaaccauguccc

SEQ ID NO: 14448 - RNA, 18 nt, artificial
  Chemically synthesized
gguucuggacucgccuug

SEQ ID NO: 14449 - RNA, 18 nt, artificial
  Chemically synthesized
aaccuucagcagugacaa

SEQ ID NO: 14450 - RNA, 18 nt, artificial
  Chemically synthesized
gccaccugcagagagcuu

SEQ ID NO: 14451 - RNA, 18 nt, artificial
  Chemically synthesized
gugggaaagucccaucac

SEQ ID NO: 14452 - RNA, 18 nt, artificial
  Chemically synthesized
caucacauuucauguccu

SEQ ID NO: 14453 - RNA, 18 nt, artificial
  Chemically synthesized
auaucuugcauccugagu

SEQ ID NO: 14454 - RNA, 18 nt, artificial
  Chemically synthesized
cuggagacacaagcggac

SEQ ID NO: 14455 - RNA, 18 nt, artificial
  Chemically synthesized
auuccuacuucuuacgcc

SEQ ID NO: 14456 - RNA, 18 nt, artificial
  Chemically synthesized
cacguuuuucuagguaca

SEQ ID NO: 14457 - RNA, 18 nt, artificial
  Chemically synthesized
gagcugggacccagcauu

SEQ ID NO: 14458 - RNA, 18 nt, artificial
  Chemically synthesized
ggaauauaucuugcaucc

SEQ ID NO: 14459 - RNA, 18 nt, artificial
  Chemically synthesized
cucugagccauucacaca

SEQ ID NO: 14460 - RNA, 18 nt, artificial
  Chemically synthesized
cuguaaugaugugagcag

SEQ ID NO: 14461 - RNA, 18 nt, artificial
  Chemically synthesized
guccugcauggaaccagu

SEQ ID NO: 14462 - RNA, 18 nt, artificial
  Chemically synthesized
ggcgccgccugucucugu

SEQ ID NO: 14463 - RNA, 18 nt, artificial
  Chemically synthesized
acagugaugccuacugau

SEQ ID NO: 14464 - RNA, 18 nt, artificial
  Chemically synthesized
cugagggagccuaaccau

SEQ ID NO: 14465 - RNA, 18 nt, artificial
  Chemically synthesized
aacaaugaacugcagaca

SEQ ID NO: 14466 - RNA, 18 nt, artificial
  Chemically synthesized
gacacuauagaacaggac

SEQ ID NO: 14467 - RNA, 18 nt, artificial
  Chemically synthesized
ccgcaggagaaagaggaa

SEQ ID NO: 14468 - RNA, 18 nt, artificial
  Chemically synthesized
cagcucagcucugagcca

SEQ ID NO: 14469 - RNA, 18 nt, artificial
  Chemically synthesized
gcugggacccagcauuga

SEQ ID NO: 14470 - RNA, 18 nt, artificial
  Chemically synthesized
cuccuucccagagcaauu

SEQ ID NO: 14471 - RNA, 18 nt, artificial
  Chemically synthesized
gagacucgccugagcagc

SEQ ID NO: 14472 - RNA, 18 nt, artificial
  Chemically synthesized
gggaagcaguuuggccca

SEQ ID NO: 14473 - RNA, 18 nt, artificial
  Chemically synthesized
ggagacacaagcggaccc

SEQ ID NO: 14474 - RNA, 18 nt, artificial
  Chemically synthesized
cucauugaaaccaaacuc

SEQ ID NO: 14475 - RNA, 18 nt, artificial
  Chemically synthesized
gcaauuuauacuuuaccc

SEQ ID NO: 14476 - RNA, 18 nt, artificial
  Chemically synthesized
cuugaacgugcggacaca

SEQ ID NO: 14477 - RNA, 18 nt, artificial
  Chemically synthesized
caucuuucacaccuccca

SEQ ID NO: 14478 - RNA, 18 nt, artificial
  Chemically synthesized
cauggaaccaguggcugu

SEQ ID NO: 14479 - RNA, 18 nt, artificial
  Chemically synthesized
accugcagagcaaggaau

SEQ ID NO: 14480 - RNA, 18 nt, artificial
  Chemically synthesized
ggcuuggcugcgggagag

SEQ ID NO: 14481 - RNA, 18 nt, artificial
  Chemically synthesized
gucacuguaaugauguga

SEQ ID NO: 14482 - RNA, 18 nt, artificial
  Chemically synthesized
cucagcuccaccuggcau

SEQ ID NO: 14483 - RNA, 18 nt, artificial
  Chemically synthesized
uguguuugaaucccugua

SEQ ID NO: 14484 - RNA, 18 nt, artificial
  Chemically synthesized
cccagcccaaggagaccc

SEQ ID NO: 14485 - RNA, 18 nt, artificial
  Chemically synthesized
cagcauacacacguuuuu

SEQ ID NO: 14486 - RNA, 18 nt, artificial
  Chemically synthesized
caucaaguacaaggcaau

SEQ ID NO: 14487 - RNA, 18 nt, artificial
  Chemically synthesized
cuggcuguugcuggacua

SEQ ID NO: 14488 - RNA, 18 nt, artificial
  Chemically synthesized
gccaaggccuugucccug

SEQ ID NO: 14489 - RNA, 18 nt, artificial
  Chemically synthesized
gaccucaaggguagaggu

SEQ ID NO: 14490 - RNA, 18 nt, artificial
  Chemically synthesized
ugggcacauacagacuca

SEQ ID NO: 14491 - RNA, 18 nt, artificial
  Chemically synthesized
aguggcugugaguggcau

SEQ ID NO: 14492 - RNA, 18 nt, artificial
  Chemically synthesized
aacagagaguagcugugu

SEQ ID NO: 14493 - RNA, 18 nt, artificial
  Chemically synthesized
ugaguggcauguccacuu

SEQ ID NO: 14494 - RNA, 18 nt, artificial
  Chemically synthesized
cuggauuaucagccagga

SEQ ID NO: 14495 - RNA, 18 nt, artificial
  Chemically synthesized
cucuccuucccagagcaa

SEQ ID NO: 14496 - RNA, 18 nt, artificial
  Chemically synthesized
gccauucuuccuauaucc

SEQ ID NO: 14497 - RNA, 18 nt, artificial
  Chemically synthesized
ggugggaaagucccauca

SEQ ID NO: 14498 - RNA, 18 nt, artificial
  Chemically synthesized
gcgggcaucaccacacuu

SEQ ID NO: 14499 - RNA, 18 nt, artificial
  Chemically synthesized
ugucuggucuauugcuag

SEQ ID NO: 14500 - RNA, 18 nt, artificial
  Chemically synthesized
agcaaggaaugugacuuc

SEQ ID NO: 14501 - RNA, 18 nt, artificial
  Chemically synthesized
gggcagggcggcgcuucu

SEQ ID NO: 14502 - RNA, 18 nt, artificial
  Chemically synthesized
aauugggcacucaucuau

SEQ ID NO: 14503 - RNA, 18 nt, artificial
  Chemically synthesized
caccucucaucugcaucu

SEQ ID NO: 14504 - RNA, 18 nt, artificial
  Chemically synthesized
agcguuucgaugccuuca

SEQ ID NO: 14505 - RNA, 18 nt, artificial
  Chemically synthesized
cuggacaucacauuucau

SEQ ID NO: 14506 - RNA, 18 nt, artificial
  Chemically synthesized
gucugaccgcgauguccu

SEQ ID NO: 14507 - RNA, 18 nt, artificial
  Chemically synthesized
cuuggcugcgggagagcu

SEQ ID NO: 14508 - RNA, 18 nt, artificial
  Chemically synthesized
caaggcaaugaagaaaga

SEQ ID NO: 14509 - RNA, 18 nt, artificial
  Chemically synthesized
gaagcgcuggcagacaau

SEQ ID NO: 14510 - RNA, 18 nt, artificial
  Chemically synthesized
gucucugaugauuaccug

SEQ ID NO: 14511 - RNA, 18 nt, artificial
  Chemically synthesized
agcagagccagcucagcu

SEQ ID NO: 14512 - RNA, 18 nt, artificial
  Chemically synthesized
gcucucagcuccaccugg

SEQ ID NO: 14513 - RNA, 18 nt, artificial
  Chemically synthesized
aaauugggcacucaucua

SEQ ID NO: 14514 - RNA, 18 nt, artificial
  Chemically synthesized
cgcugaggcuccaggacc

SEQ ID NO: 14515 - RNA, 18 nt, artificial
  Chemically synthesized
gaacugcagacacagcug

SEQ ID NO: 14516 - RNA, 18 nt, artificial
  Chemically synthesized
cauccaguuugugcagga

SEQ ID NO: 14517 - RNA, 18 nt, artificial
  Chemically synthesized
caaagcuugugggcacau

SEQ ID NO: 14518 - RNA, 18 nt, artificial
  Chemically synthesized
gauugccuuacaaaguua

SEQ ID NO: 14519 - RNA, 18 nt, artificial
  Chemically synthesized
ugcaccaaaucuugguuc

SEQ ID NO: 14520 - RNA, 18 nt, artificial
  Chemically synthesized
agcuggcuguugcuggac

SEQ ID NO: 14521 - RNA, 18 nt, artificial
  Chemically synthesized
ggaugccuguggucaugc

SEQ ID NO: 14522 - RNA, 18 nt, artificial
  Chemically synthesized
caacuucacagacacguc

SEQ ID NO: 14523 - RNA, 18 nt, artificial
  Chemically synthesized
gcugugaccacgacacug

SEQ ID NO: 14524 - RNA, 18 nt, artificial
  Chemically synthesized
ggcgggcaucaccacacu

SEQ ID NO: 14525 - RNA, 18 nt, artificial
  Chemically synthesized
cuggacgccuggcaggga

SEQ ID NO: 14526 - RNA, 18 nt, artificial
  Chemically synthesized
guggugguugucucugau

SEQ ID NO: 14527 - RNA, 18 nt, artificial
  Chemically synthesized
cgccucgagaccucaagg

SEQ ID NO: 14528 - RNA, 18 nt, artificial
  Chemically synthesized
gucccaucacugagggag

SEQ ID NO: 14529 - RNA, 18 nt, artificial
  Chemically synthesized
ccuggccucuggcauauu

SEQ ID NO: 14530 - RNA, 18 nt, artificial
  Chemically synthesized
caggcaccagcauacaca

SEQ ID NO: 14531 - RNA, 18 nt, artificial
  Chemically synthesized
gagccuaaccaugucccu

SEQ ID NO: 14532 - RNA, 18 nt, artificial
  Chemically synthesized
uccuccacauccucccuu

SEQ ID NO: 14533 - RNA, 18 nt, artificial
  Chemically synthesized
augaucuuguugaggcau

SEQ ID NO: 14534 - RNA, 18 nt, artificial
  Chemically synthesized
aagcauagcucugggucu

SEQ ID NO: 14535 - RNA, 18 nt, artificial
  Chemically synthesized
agacuguucugaggcccu

SEQ ID NO: 14536 - RNA, 18 nt, artificial
  Chemically synthesized
gcuguguuugaaucccug

SEQ ID NO: 14537 - RNA, 18 nt, artificial
  Chemically synthesized
ugagccauucacacaucu

SEQ ID NO: 14538 - RNA, 18 nt, artificial
  Chemically synthesized
acaucacccgccucgaga

SEQ ID NO: 14539 - RNA, 18 nt, artificial
  Chemically synthesized
agggagccuuccucccug

SEQ ID NO: 14540 - RNA, 18 nt, artificial
  Chemically synthesized
gaugcuucagugccucug

SEQ ID NO: 14541 - RNA, 18 nt, artificial
  Chemically synthesized
uguccugcauggaaccag

SEQ ID NO: 14542 - RNA, 18 nt, artificial
  Chemically synthesized
caugagaagggauccugg

SEQ ID NO: 14543 - RNA, 18 nt, artificial
  Chemically synthesized
acaaaaauugggcacuca

SEQ ID NO: 14544 - RNA, 18 nt, artificial
  Chemically synthesized
cuguugcuggacuacaug

SEQ ID NO: 14545 - RNA, 18 nt, artificial
  Chemically synthesized
ccaccucucaucugcauc

SEQ ID NO: 14546 - RNA, 18 nt, artificial
  Chemically synthesized
gucugcagcagcuggaca

SEQ ID NO: 14547 - RNA, 18 nt, artificial
  Chemically synthesized
guccacuugcuggauuau

SEQ ID NO: 14548 - RNA, 18 nt, artificial
  Chemically synthesized
ucugagaaaagccgauau

SEQ ID NO: 14549 - RNA, 18 nt, artificial
  Chemically synthesized
agguacagcucccaggaa

SEQ ID NO: 14550 - RNA, 18 nt, artificial
  Chemically synthesized
guguguaucugucugccu

SEQ ID NO: 14551 - RNA, 18 nt, artificial
  Chemically synthesized
ggaagcaguuuggcccag

SEQ ID NO: 14552 - RNA, 18 nt, artificial
  Chemically synthesized
ggccacugcugugaccac

SEQ ID NO: 14553 - RNA, 18 nt, artificial
  Chemically synthesized
gagaugauccggcaacug

SEQ ID NO: 14554 - RNA, 18 nt, artificial
  Chemically synthesized
agcagugucccacggaca

SEQ ID NO: 14555 - RNA, 18 nt, artificial
  Chemically synthesized
gcuggcagacaaugcgac

SEQ ID NO: 14556 - RNA, 18 nt, artificial
  Chemically synthesized
acucauugaaaccaaacu

SEQ ID NO: 14557 - RNA, 18 nt, artificial
  Chemically synthesized
ggaaauggugaagcauag

SEQ ID NO: 14558 - RNA, 18 nt, artificial
  Chemically synthesized
cuuucacaccucccagcu

SEQ ID NO: 14559 - RNA, 18 nt, artificial
  Chemically synthesized
gcagcuugggcugcuuuu

SEQ ID NO: 14560 - RNA, 18 nt, artificial
  Chemically synthesized
ugauuaccugcagagcaa

SEQ ID NO: 14561 - RNA, 18 nt, artificial
  Chemically synthesized
gaagcacagagagaggaa

SEQ ID NO: 14562 - RNA, 18 nt, artificial
  Chemically synthesized
accucucaucugcaucuu

SEQ ID NO: 14563 - RNA, 18 nt, artificial
  Chemically synthesized
auggugaagcauagcucu

SEQ ID NO: 14564 - RNA, 18 nt, artificial
  Chemically synthesized
gauauuugccauucuucc

SEQ ID NO: 14565 - RNA, 18 nt, artificial
  Chemically synthesized
ccucucuccuucccagag

SEQ ID NO: 14566 - RNA, 18 nt, artificial
  Chemically synthesized
guugcuggacuacaugcu

SEQ ID NO: 14567 - RNA, 18 nt, artificial
  Chemically synthesized
cuucagugccucugcaca

SEQ ID NO: 14568 - RNA, 18 nt, artificial
  Chemically synthesized
ccaggugcccaucagaag

SEQ ID NO: 14569 - RNA, 18 nt, artificial
  Chemically synthesized
ccauguacuucugcccug

SEQ ID NO: 14570 - RNA, 18 nt, artificial
  Chemically synthesized
cuuggagauccggcaacu

SEQ ID NO: 14571 - RNA, 18 nt, artificial
  Chemically synthesized
agcuugggcugcuuuuca

SEQ ID NO: 14572 - RNA, 18 nt, artificial
  Chemically synthesized
gcauguccacuugcugga

SEQ ID NO: 14573 - RNA, 18 nt, artificial
  Chemically synthesized
cccaaccuucagcaguga

SEQ ID NO: 14574 - RNA, 18 nt, artificial
  Chemically synthesized
guagcuguguuugaaucc

SEQ ID NO: 14575 - RNA, 18 nt, artificial
  Chemically synthesized
agaggaagcgcuggcaga

SEQ ID NO: 14576 - RNA, 18 nt, artificial
  Chemically synthesized
guaggaggaaucugugcu

SEQ ID NO: 14577 - RNA, 18 nt, artificial
  Chemically synthesized
gagguucaucacugucug

SEQ ID NO: 14578 - RNA, 18 nt, artificial
  Chemically synthesized
gcuuuucauuuccaccug

SEQ ID NO: 14579 - RNA, 18 nt, artificial
  Chemically synthesized
auccugagguucaucacu

SEQ ID NO: 14580 - RNA, 18 nt, artificial
  Chemically synthesized
gcuugggcugcuuuucau

SEQ ID NO: 14581 - RNA, 18 nt, artificial
  Chemically synthesized
agccagcucagcucugag

SEQ ID NO: 14582 - RNA, 18 nt, artificial
  Chemically synthesized
augucccugaacaaaaau

SEQ ID NO: 14583 - RNA, 18 nt, artificial
  Chemically synthesized
aguugugugugucugacc

SEQ ID NO: 14584 - RNA, 18 nt, artificial
  Chemically synthesized
uaucuugcauccugaguu

SEQ ID NO: 14585 - RNA, 18 nt, artificial
  Chemically synthesized
agcagcuggacaucacau

SEQ ID NO: 14586 - RNA, 18 nt, artificial
  Chemically synthesized
ugggcauuuuaaagccau

SEQ ID NO: 14587 - RNA, 18 nt, artificial
  Chemically synthesized
cuaggacccuaaauccaa

SEQ ID NO: 14588 - RNA, 18 nt, artificial
  Chemically synthesized
ccuccacauccucccuuc

SEQ ID NO: 14589 - RNA, 18 nt, artificial
  Chemically synthesized
cauguccacuugcuggau

SEQ ID NO: 14590 - RNA, 18 nt, artificial
  Chemically synthesized
guuguaggaggaaucugu

SEQ ID NO: 14591 - RNA, 18 nt, artificial
  Chemically synthesized
acuuggagauccggcaac

SEQ ID NO: 14592 - RNA, 18 nt, artificial
  Chemically synthesized
acugcugugaccacgaca

SEQ ID NO: 14593 - RNA, 18 nt, artificial
  Chemically synthesized
gcugcuggacgccuggca

SEQ ID NO: 14594 - RNA, 18 nt, artificial
  Chemically synthesized
gaaggugccauggucuua

SEQ ID NO: 14595 - RNA, 18 nt, artificial
  Chemically synthesized
cucucacacacacaggca

SEQ ID NO: 14596 - RNA, 18 nt, artificial
  Chemically synthesized
gaguggcauguccacuug

SEQ ID NO: 14597 - RNA, 18 nt, artificial
  Chemically synthesized
ugcacaccgcccauucca

SEQ ID NO: 14598 - RNA, 18 nt, artificial
  Chemically synthesized
cauccugagguucaucac

SEQ ID NO: 14599 - RNA, 18 nt, artificial
  Chemically synthesized
gagagcuuucccaccaac

SEQ ID NO: 14600 - RNA, 18 nt, artificial
  Chemically synthesized
cccauuccacuuccuccu

SEQ ID NO: 14601 - RNA, 18 nt, artificial
  Chemically synthesized
ugagcucaucgaaaagag

SEQ ID NO: 14602 - RNA, 18 nt, artificial
  Chemically synthesized
ggacccagcauugaggag

SEQ ID NO: 14603 - RNA, 18 nt, artificial
  Chemically synthesized
uuugaguacuuggagauc

SEQ ID NO: 14604 - RNA, 18 nt, artificial
  Chemically synthesized
cagacaaugcgacccgac

SEQ ID NO: 14605 - RNA, 18 nt, artificial
  Chemically synthesized
cucacuugaggaguggga

SEQ ID NO: 14606 - RNA, 18 nt, artificial
  Chemically synthesized
agcacagagagaggaaga

SEQ ID NO: 14607 - RNA, 18 nt, artificial
  Chemically synthesized
acagcagugucccacgga

SEQ ID NO: 14608 - RNA, 18 nt, artificial
  Chemically synthesized
ucuuguugaggcauuuag

SEQ ID NO: 14609 - RNA, 18 nt, artificial
  Chemically synthesized
cuucagcagugacaaguc

SEQ ID NO: 14610 - RNA, 18 nt, artificial
  Chemically synthesized
gcgauguccugccuggca

SEQ ID NO: 14611 - RNA, 18 nt, artificial
  Chemically synthesized
ccuuuucucuuguguccc

SEQ ID NO: 14612 - RNA, 18 nt, artificial
  Chemically synthesized
cacuugcuggauuaucag

SEQ ID NO: 14613 - RNA, 18 nt, artificial
  Chemically synthesized
ccggaugguggugguugu

SEQ ID NO: 14614 - RNA, 18 nt, artificial
  Chemically synthesized
ccgccauggcugcaggag

SEQ ID NO: 14615 - RNA, 18 nt, artificial
  Chemically synthesized
gaggaggauugccaaaag

SEQ ID NO: 14616 - RNA, 18 nt, artificial
  Chemically synthesized
ccgcuguagacagcagug

SEQ ID NO: 14617 - RNA, 18 nt, artificial
  Chemically synthesized
aucucaagaggcaucuuc

SEQ ID NO: 14618 - RNA, 18 nt, artificial
  Chemically synthesized
gaagggauccuggccucu

SEQ ID NO: 14619 - RNA, 18 nt, artificial
  Chemically synthesized
cagcgaccauauaaaagc

SEQ ID NO: 14620 - RNA, 18 nt, artificial
  Chemically synthesized
guuuacaaacagcgacca

SEQ ID NO: 14621 - RNA, 18 nt, artificial
  Chemically synthesized
gucugccuguccauguac

SEQ ID NO: 14622 - RNA, 18 nt, artificial
  Chemically synthesized
accagcauacacacguuu

SEQ ID NO: 14623 - RNA, 18 nt, artificial
  Chemically synthesized
agacagcagugucccacg

SEQ ID NO: 14624 - RNA, 18 nt, artificial
  Chemically synthesized
cccugggccaccugcaga

SEQ ID NO: 14625 - RNA, 18 nt, artificial
  Chemically synthesized
gggagccuaaccaugucc

SEQ ID NO: 14626 - RNA, 18 nt, artificial
  Chemically synthesized
aacuuuguaccuugauug

SEQ ID NO: 14627 - RNA, 18 nt, artificial
  Chemically synthesized
acagagaguagcuguguu

SEQ ID NO: 14628 - RNA, 18 nt, artificial
  Chemically synthesized
cuguccauguacuucugc

SEQ ID NO: 14629 - RNA, 18 nt, artificial
  Chemically synthesized
caucucaagaggcaucuu

SEQ ID NO: 14630 - RNA, 18 nt, artificial
  Chemically synthesized
aauggguccaccucucau

SEQ ID NO: 14631 - RNA, 18 nt, artificial
  Chemically synthesized
ugcuccacuuucagccag

SEQ ID NO: 14632 - RNA, 18 nt, artificial
  Chemically synthesized
cugcagagcaaggaaugu

SEQ ID NO: 14633 - RNA, 18 nt, artificial
  Chemically synthesized
uccugagguucaucacug

SEQ ID NO: 14634 - RNA, 18 nt, artificial
  Chemically synthesized
acguuuuucuagguacag

SEQ ID NO: 14635 - RNA, 18 nt, artificial
  Chemically synthesized
cagacacgucugcagcag

SEQ ID NO: 14636 - RNA, 18 nt, artificial
  Chemically synthesized
cagcauccugagguucau

SEQ ID NO: 14637 - RNA, 18 nt, artificial
  Chemically synthesized
gcugcgggagagcuggcu

SEQ ID NO: 14638 - RNA, 18 nt, artificial
  Chemically synthesized
gcuggcggaggagaugga

SEQ ID NO: 14639 - RNA, 18 nt, artificial
  Chemically synthesized
cugcgggagagcuggcug

SEQ ID NO: 14640 - RNA, 18 nt, artificial
  Chemically synthesized
uggguguguguguaucug

SEQ ID NO: 14641 - RNA, 18 nt, artificial
  Chemically synthesized
cauagcucugggucuccu

SEQ ID NO: 14642 - RNA, 18 nt, artificial
  Chemically synthesized
gcugcuuuucauuuccac

SEQ ID NO: 14643 - RNA, 18 nt, artificial
  Chemically synthesized
guggcauguccacuugcu

SEQ ID NO: 14644 - RNA, 18 nt, artificial
  Chemically synthesized
ugaagacuguucugaggc

SEQ ID NO: 14645 - RNA, 18 nt, artificial
  Chemically synthesized
ugcagcagcuggacauca

SEQ ID NO: 14646 - RNA, 18 nt, artificial
  Chemically synthesized
gacaucacauuucauguc

SEQ ID NO: 14647 - RNA, 18 nt, artificial
  Chemically synthesized
cuauagaacaggaccagc

SEQ ID NO: 14648 - RNA, 18 nt, artificial
  Chemically synthesized
gaggagauggacuuugag

SEQ ID NO: 14649 - RNA, 18 nt, artificial
  Chemically synthesized
uugccauucuuccuauau

SEQ ID NO: 14650 - RNA, 18 nt, artificial
  Chemically synthesized
caacuggaacagacaaac

SEQ ID NO: 14651 - RNA, 18 nt, artificial
  Chemically synthesized
acuaucgacugaaguugu

SEQ ID NO: 14652 - RNA, 18 nt, artificial
  Chemically synthesized
agcagcuugggcugcuuu

SEQ ID NO: 14653 - RNA, 18 nt, artificial
  Chemically synthesized
accaguggcugugagugg

SEQ ID NO: 14654 - RNA, 18 nt, artificial
  Chemically synthesized
acccucaguuuccucacu

SEQ ID NO: 14655 - RNA, 18 nt, artificial
  Chemically synthesized
aagagacucgccugagca

SEQ ID NO: 14656 - RNA, 18 nt, artificial
  Chemically synthesized
cuggcaccugugucuggu

SEQ ID NO: 14657 - RNA, 18 nt, artificial
  Chemically synthesized
agacacgucugcagcagc

SEQ ID NO: 14658 - RNA, 18 nt, artificial
  Chemically synthesized
ggacagcagagcuggcgg

SEQ ID NO: 14659 - RNA, 18 nt, artificial
  Chemically synthesized
cuuuucauuuccaccugu

SEQ ID NO: 14660 - RNA, 18 nt, artificial
  Chemically synthesized
agugaugccuacugaugc

SEQ ID NO: 14661 - RNA, 18 nt, artificial
  Chemically synthesized
uguugaggcauuuagcug

SEQ ID NO: 14662 - RNA, 18 nt, artificial
  Chemically synthesized
uagugagcucaucgaaaa

SEQ ID NO: 14663 - RNA, 18 nt, artificial
  Chemically synthesized
ugccaacuucacagacac

SEQ ID NO: 14664 - RNA, 18 nt, artificial
  Chemically synthesized
gggagggaauggaugccc

SEQ ID NO: 14665 - RNA, 18 nt, artificial
  Chemically synthesized
gaugguggugguugucuc

SEQ ID NO: 14666 - RNA, 18 nt, artificial
  Chemically synthesized
agagcuuucccaccaacu

SEQ ID NO: 14667 - RNA, 18 nt, artificial
  Chemically synthesized
cauuuagcugccaugcac

SEQ ID NO: 14668 - RNA, 18 nt, artificial
  Chemically synthesized
augugagcagggagccuu

SEQ ID NO: 14669 - RNA, 18 nt, artificial
  Chemically synthesized
cccaucagaagcgacuga

SEQ ID NO: 14670 - RNA, 18 nt, artificial
  Chemically synthesized
cuucuuccacagugaugc

SEQ ID NO: 14671 - RNA, 18 nt, artificial
  Chemically synthesized
cagcgacauccaguuugu

SEQ ID NO: 14672 - RNA, 18 nt, artificial
  Chemically synthesized
gaagcaguuuggcccagc

SEQ ID NO: 14673 - RNA, 18 nt, artificial
  Chemically synthesized
accuuuucuuaggaucuu

SEQ ID NO: 14674 - RNA, 18 nt, artificial
  Chemically synthesized
ggacgcccuggcgccucu

SEQ ID NO: 14675 - RNA, 18 nt, artificial
  Chemically synthesized
aguagcuguguuugaauc

SEQ ID NO: 14676 - RNA, 18 nt, artificial
  Chemically synthesized
gauugccaaaaguauauc

SEQ ID NO: 14677 - RNA, 18 nt, artificial
  Chemically synthesized
uguacucucacacacaca

SEQ ID NO: 14678 - RNA, 18 nt, artificial
  Chemically synthesized
uggacaucacauuucaug

SEQ ID NO: 14679 - RNA, 18 nt, artificial
  Chemically synthesized
cugcagagagcuuuccca

SEQ ID NO: 14680 - RNA, 18 nt, artificial
  Chemically synthesized
cugggacccagcauugag

SEQ ID NO: 14681 - RNA, 18 nt, artificial
  Chemically synthesized
gcgcuggcggaggagaug

SEQ ID NO: 14682 - RNA, 18 nt, artificial
  Chemically synthesized
cacacacaggcaccagca

SEQ ID NO: 14683 - RNA, 18 nt, artificial
  Chemically synthesized
gccgccggaugguggugg

SEQ ID NO: 14684 - RNA, 18 nt, artificial
  Chemically synthesized
acauuucauguccugcau

SEQ ID NO: 14685 - RNA, 18 nt, artificial
  Chemically synthesized
cucuccaggugcccauca

SEQ ID NO: 14686 - RNA, 18 nt, artificial
  Chemically synthesized
gccaacuucacagacacg

SEQ ID NO: 14687 - RNA, 18 nt, artificial
  Chemically synthesized
gagcugcuuaccaagcug

SEQ ID NO: 14688 - RNA, 18 nt, artificial
  Chemically synthesized
caccacacuugaugaccc

SEQ ID NO: 14689 - RNA, 18 nt, artificial
  Chemically synthesized
caucagaagcgacugauc

SEQ ID NO: 14690 - RNA, 18 nt, artificial
  Chemically synthesized
acaugggcacauacagac

SEQ ID NO: 14691 - RNA, 18 nt, artificial
  Chemically synthesized
guguaucugucugccugu

SEQ ID NO: 14692 - RNA, 18 nt, artificial
  Chemically synthesized
agcgacauccaguuugug

SEQ ID NO: 14693 - RNA, 18 nt, artificial
  Chemically synthesized
guaggaaauggugaagca

SEQ ID NO: 14694 - RNA, 18 nt, artificial
  Chemically synthesized
uguccacuugcuggauua

SEQ ID NO: 14695 - RNA, 18 nt, artificial
  Chemically synthesized
guccaccucucaucugca

SEQ ID NO: 14696 - RNA, 18 nt, artificial
  Chemically synthesized
guagacagcaguguccca

SEQ ID NO: 14697 - RNA, 18 nt, artificial
  Chemically synthesized
ccaaacucuggaaaggac

SEQ ID NO: 14698 - RNA, 18 nt, artificial
  Chemically synthesized
ccucucugcaugaucuug

SEQ ID NO: 14699 - RNA, 18 nt, artificial
  Chemically synthesized
aauuugcacucagccucu

SEQ ID NO: 14700 - RNA, 18 nt, artificial
  Chemically synthesized
uggagacacaagcggacc

SEQ ID NO: 14701 - RNA, 18 nt, artificial
  Chemically synthesized
uggccucuggcauauuca

SEQ ID NO: 14702 - RNA, 18 nt, artificial
  Chemically synthesized
ugcuuuucauuuccaccu

SEQ ID NO: 14703 - RNA, 18 nt, artificial
  Chemically synthesized
cacaccgcccauuccacu

SEQ ID NO: 14704 - RNA, 18 nt, artificial
  Chemically synthesized
cugaacaaaaauugggca

SEQ ID NO: 14705 - RNA, 18 nt, artificial
  Chemically synthesized
cuggcggaggagauggac

SEQ ID NO: 14706 - RNA, 18 nt, artificial
  Chemically synthesized
gaacagagaguagcugug

SEQ ID NO: 14707 - RNA, 18 nt, artificial
  Chemically synthesized
agaagccuuuacaggugg

SEQ ID NO: 14708 - RNA, 18 nt, artificial
  Chemically synthesized
aagauaucugagaaaagc

SEQ ID NO: 14709 - RNA, 18 nt, artificial
  Chemically synthesized
uccacuuucagccaggcu

SEQ ID NO: 14710 - RNA, 18 nt, artificial
  Chemically synthesized
gggacccagcauugagga

SEQ ID NO: 14711 - RNA, 18 nt, artificial
  Chemically synthesized
aauuccuggagaugccaa

SEQ ID NO: 14712 - RNA, 18 nt, artificial
  Chemically synthesized
ccaggacagacccuagga

SEQ ID NO: 14713 - RNA, 18 nt, artificial
  Chemically synthesized
aacugcagacacagcugu

SEQ ID NO: 14714 - RNA, 18 nt, artificial
  Chemically synthesized
agcucugggucuccuggg

SEQ ID NO: 14715 - RNA, 18 nt, artificial
  Chemically synthesized
caccgcccauuccacuuc

SEQ ID NO: 14716 - RNA, 18 nt, artificial
  Chemically synthesized
ggccgcuguagacagcag

SEQ ID NO: 14717 - RNA, 18 nt, artificial
  Chemically synthesized
accucaaggguagaggug

SEQ ID NO: 14718 - RNA, 18 nt, artificial
  Chemically synthesized
cagcagagcuggcgggca

SEQ ID NO: 14719 - RNA, 18 nt, artificial
  Chemically synthesized
ccaggaacagcuaggugg

SEQ ID NO: 14720 - RNA, 18 nt, artificial
  Chemically synthesized
ucugugcucuacuuaccu

SEQ ID NO: 14721 - RNA, 18 nt, artificial
  Chemically synthesized
cugagcguuucgaugccu

SEQ ID NO: 14722 - RNA, 18 nt, artificial
  Chemically synthesized
cugcauggaaccaguggc

SEQ ID NO: 14723 - RNA, 18 nt, artificial
  Chemically synthesized
cagagccagcucagcucu

SEQ ID NO: 14724 - RNA, 18 nt, artificial
  Chemically synthesized
ggauccuggccucuggca

SEQ ID NO: 14725 - RNA, 18 nt, artificial
  Chemically synthesized
auggacuuugaguacuug

SEQ ID NO: 14726 - RNA, 18 nt, artificial
  Chemically synthesized
agacaaugcgacccgacc

SEQ ID NO: 14727 - RNA, 18 nt, artificial
  Chemically synthesized
cgccauggcugcaggagg

SEQ ID NO: 14728 - RNA, 18 nt, artificial
  Chemically synthesized
caacuggagacacaagcg

SEQ ID NO: 14729 - RNA, 18 nt, artificial
  Chemically synthesized
auauaucuugcauccuga

SEQ ID NO: 14730 - RNA, 18 nt, artificial
  Chemically synthesized
caucacugucugcgacua

SEQ ID NO: 14731 - RNA, 18 nt, artificial
  Chemically synthesized
gucaugcucucagcucca

SEQ ID NO: 14732 - RNA, 18 nt, artificial
  Chemically synthesized
acagcuaggugggaaagu

SEQ ID NO: 14733 - RNA, 18 nt, artificial
  Chemically synthesized
ccugagguucaucacugu

SEQ ID NO: 14734 - RNA, 18 nt, artificial
  Chemically synthesized
gccgacugcucgagcugc

SEQ ID NO: 14735 - RNA, 18 nt, artificial
  Chemically synthesized
cugagguucaucacuguc

SEQ ID NO: 14736 - RNA, 18 nt, artificial
  Chemically synthesized
ucucuguucuugaacgug

SEQ ID NO: 14737 - RNA, 18 nt, artificial
  Chemically synthesized
gccuggcaccugugucug

SEQ ID NO: 14738 - RNA, 18 nt, artificial
  Chemically synthesized
gcuuggcugcgggagagc

SEQ ID NO: 14739 - RNA, 18 nt, artificial
  Chemically synthesized
ugcuggauuaucagccag

SEQ ID NO: 14740 - RNA, 18 nt, artificial
  Chemically synthesized
agcuguucucucccucuc

SEQ ID NO: 14741 - RNA, 18 nt, artificial
  Chemically synthesized
uccagaccaaauuugcac

SEQ ID NO: 14742 - RNA, 18 nt, artificial
  Chemically synthesized
cccugcaccaaaucuugg

SEQ ID NO: 14743 - RNA, 18 nt, artificial
  Chemically synthesized
acagguggccgcuguaga

SEQ ID NO: 14744 - RNA, 18 nt, artificial
  Chemically synthesized
acaucacauuucaugucc

SEQ ID NO: 14745 - RNA, 18 nt, artificial
  Chemically synthesized
ugggcacucaucuauucc

SEQ ID NO: 14746 - RNA, 18 nt, artificial
  Chemically synthesized
acucaucuauuccuuuuc

SEQ ID NO: 14747 - RNA, 18 nt, artificial
  Chemically synthesized
uggguccaccucucaucu

SEQ ID NO: 14748 - RNA, 18 nt, artificial
  Chemically synthesized
ccauauaaaagccuccug

SEQ ID NO: 14749 - RNA, 18 nt, artificial
  Chemically synthesized
guggucaugcucucagcu

SEQ ID NO: 14750 - RNA, 18 nt, artificial
  Chemically synthesized
agaaaagccgauauuugc

SEQ ID NO: 14751 - RNA, 18 nt, artificial
  Chemically synthesized
uugaaucccuguaggaaa

SEQ ID NO: 14752 - RNA, 18 nt, artificial
  Chemically synthesized
ccuucaucugcuauugcc

SEQ ID NO: 14753 - RNA, 18 nt, artificial
  Chemically synthesized
cccacggacagcagagcu

SEQ ID NO: 14754 - RNA, 18 nt, artificial
  Chemically synthesized
cuggacucgccuugccaa

SEQ ID NO: 14755 - RNA, 18 nt, artificial
  Chemically synthesized
uauuugccauucuuccua

SEQ ID NO: 14756 - RNA, 18 nt, artificial
  Chemically synthesized
uucccagagcaauuuaua

SEQ ID NO: 14757 - RNA, 18 nt, artificial
  Chemically synthesized
ugagcguuucgaugccuu

SEQ ID NO: 14758 - RNA, 18 nt, artificial
  Chemically synthesized
cuacugaugcuucagugc

SEQ ID NO: 14759 - RNA, 18 nt, artificial
  Chemically synthesized
uguaccaguauuuauacc

SEQ ID NO: 14760 - RNA, 18 nt, artificial
  Chemically synthesized
uacauguuuuguacgcau

SEQ ID NO: 14761 - RNA, 18 nt, artificial
  Chemically synthesized
aggaggaggcugagaagc

SEQ ID NO: 14762 - RNA, 18 nt, artificial
  Chemically synthesized
cagagcaaggaaugugac

SEQ ID NO: 14763 - RNA, 18 nt, artificial
  Chemically synthesized
ccugcagagcaaggaaug

SEQ ID NO: 14764 - RNA, 18 nt, artificial
  Chemically synthesized
guaccuuuucuuaggauc

SEQ ID NO: 14765 - RNA, 18 nt, artificial
  Chemically synthesized
gacuguucugaggcccug

SEQ ID NO: 14766 - RNA, 18 nt, artificial
  Chemically synthesized
uggucuuaggugucugug

SEQ ID NO: 14767 - RNA, 18 nt, artificial
  Chemically synthesized
uggaaccaguggcuguga

SEQ ID NO: 14768 - RNA, 18 nt, artificial
  Chemically synthesized
cuugggagggaauggaug

SEQ ID NO: 14769 - RNA, 18 nt, artificial
  Chemically synthesized
ucugagccauucacacau

SEQ ID NO: 14770 - RNA, 18 nt, artificial
  Chemically synthesized
ggugccauggucuuaggu

SEQ ID NO: 14771 - RNA, 18 nt, artificial
  Chemically synthesized
cucuguaggccgacugcu

SEQ ID NO: 14772 - RNA, 18 nt, artificial
  Chemically synthesized
caucugcaucuuucacac

SEQ ID NO: 14773 - RNA, 18 nt, artificial
  Chemically synthesized
cacaggcaccagcauaca

SEQ ID NO: 14774 - RNA, 18 nt, artificial
  Chemically synthesized
gugucugaccgcgauguc

SEQ ID NO: 14775 - RNA, 18 nt, artificial
  Chemically synthesized
uuaucagccaggacacua

SEQ ID NO: 14776 - RNA, 18 nt, artificial
  Chemically synthesized
ccugucucuguucuugaa

SEQ ID NO: 14777 - RNA, 18 nt, artificial
  Chemically synthesized
guacucucacacacacag

SEQ ID NO: 14778 - RNA, 18 nt, artificial
  Chemically synthesized
ggaccgcccgccauggcu

SEQ ID NO: 14779 - RNA, 18 nt, artificial
  Chemically synthesized
aacuaucgacugaaguug

SEQ ID NO: 14780 - RNA, 18 nt, artificial
  Chemically synthesized
caugaucuuguugaggca

SEQ ID NO: 14781 - RNA, 18 nt, artificial
  Chemically synthesized
ccugcaccaaaucuuggu

SEQ ID NO: 14782 - RNA, 18 nt, artificial
  Chemically synthesized
gagcagggagccuuccuc

SEQ ID NO: 14783 - RNA, 18 nt, artificial
  Chemically synthesized
gugugucugaccgcgaug

SEQ ID NO: 14784 - RNA, 18 nt, artificial
  Chemically synthesized
gcagagccagcucagcuc

SEQ ID NO: 14785 - RNA, 18 nt, artificial
  Chemically synthesized
cauaucuuugcuccacuu

SEQ ID NO: 14786 - RNA, 18 nt, artificial
  Chemically synthesized
cuucacccucaguuuccu

SEQ ID NO: 14787 - RNA, 18 nt, artificial
  Chemically synthesized
acucacacaacaaugaac

SEQ ID NO: 14788 - RNA, 18 nt, artificial
  Chemically synthesized
uauguacagacauguacu

SEQ ID NO: 14789 - RNA, 18 nt, artificial
  Chemically synthesized
ggucuccuccacauccuc

SEQ ID NO: 14790 - RNA, 18 nt, artificial
  Chemically synthesized
guauaucuugaagcagca

SEQ ID NO: 14791 - RNA, 18 nt, artificial
  Chemically synthesized
gcuggagcugggacccag

SEQ ID NO: 14792 - RNA, 18 nt, artificial
  Chemically synthesized
ugucugcgacuacaccaa

SEQ ID NO: 14793 - RNA, 18 nt, artificial
  Chemically synthesized
aaugaacugcagacacag

SEQ ID NO: 14794 - RNA, 18 nt, artificial
  Chemically synthesized
uacugaugcuucagugcc

SEQ ID NO: 14795 - RNA, 18 nt, artificial
  Chemically synthesized
cugggcauuuuaaagcca

SEQ ID NO: 14796 - RNA, 18 nt, artificial
  Chemically synthesized
cccaggaacagcuaggug

SEQ ID NO: 14797 - RNA, 18 nt, artificial
  Chemically synthesized
gaacagcuaggugggaaa

SEQ ID NO: 14798 - RNA, 18 nt, artificial
  Chemically synthesized
cccaccaacuuuguaccu

SEQ ID NO: 14799 - RNA, 18 nt, artificial
  Chemically synthesized
aacaggaccagcugagac

SEQ ID NO: 14800 - RNA, 18 nt, artificial
  Chemically synthesized
cgaugccuucaucugcua

SEQ ID NO: 14801 - RNA, 18 nt, artificial
  Chemically synthesized
ggcugcgggagagcuggc

SEQ ID NO: 14802 - RNA, 18 nt, artificial
  Chemically synthesized
cugcucucaacaugcgag

SEQ ID NO: 14803 - RNA, 18 nt, artificial
  Chemically synthesized
ucuggcauauucaucaag

SEQ ID NO: 14804 - RNA, 18 nt, artificial
  Chemically synthesized
ugcauccugaguuuauaa

SEQ ID NO: 14805 - RNA, 18 nt, artificial
  Chemically synthesized
acuuaccucucaauuccu

SEQ ID NO: 14806 - RNA, 18 nt, artificial
  Chemically synthesized
gggcagcuucuuccacag

SEQ ID NO: 14807 - RNA, 18 nt, artificial
  Chemically synthesized
ccuguggucaugcucuca

SEQ ID NO: 14808 - RNA, 18 nt, artificial
  Chemically synthesized
ugcucucaacaugcgagu

SEQ ID NO: 14809 - RNA, 18 nt, artificial
  Chemically synthesized
uccggcaacuggaacaga

SEQ ID NO: 14810 - RNA, 18 nt, artificial
  Chemically synthesized
cuguagacagcagugucc

SEQ ID NO: 14811 - RNA, 18 nt, artificial
  Chemically synthesized
acagacaaacuaucgacu

SEQ ID NO: 14812 - RNA, 18 nt, artificial
  Chemically synthesized
ucacuugaggagugggau

SEQ ID NO: 14813 - RNA, 18 nt, artificial
  Chemically synthesized
cagcuaggugggaaaguc

SEQ ID NO: 14814 - RNA, 18 nt, artificial
  Chemically synthesized
ugcauaucuuugcuccac

SEQ ID NO: 14815 - RNA, 18 nt, artificial
  Chemically synthesized
aucuucacccucaguuuc

SEQ ID NO: 14816 - RNA, 18 nt, artificial
  Chemically synthesized
gauuaucagccaggacac

SEQ ID NO: 14817 - RNA, 18 nt, artificial
  Chemically synthesized
agcgcuggcagacaaugc

SEQ ID NO: 14818 - RNA, 18 nt, artificial
  Chemically synthesized
ucucaauuccuggagaug

SEQ ID NO: 14819 - RNA, 18 nt, artificial
  Chemically synthesized
cgauguccugccuggcac

SEQ ID NO: 14820 - RNA, 18 nt, artificial
  Chemically synthesized
aaauuugcacucagccuc

SEQ ID NO: 14821 - RNA, 18 nt, artificial
  Chemically synthesized
gaaaaugcauaucuuugc

SEQ ID NO: 14822 - RNA, 18 nt, artificial
  Chemically synthesized
cuauuccuuuucucuugu

SEQ ID NO: 14823 - RNA, 18 nt, artificial
  Chemically synthesized
uuuccucacuugaggagu

SEQ ID NO: 14824 - RNA, 18 nt, artificial
  Chemically synthesized
agcauacacacguuuuuc

SEQ ID NO: 14825 - RNA, 18 nt, artificial
  Chemically synthesized
guugaggcauuuagcugc

SEQ ID NO: 14826 - RNA, 18 nt, artificial
  Chemically synthesized
auuuccaccugucaggau

SEQ ID NO: 14827 - RNA, 18 nt, artificial
  Chemically synthesized
gggccaccugcagagagc

SEQ ID NO: 14828 - RNA, 18 nt, artificial
  Chemically synthesized
accuugagccuuauuucc

SEQ ID NO: 14829 - RNA, 18 nt, artificial
  Chemically synthesized
acucuggaaaggacccaa

SEQ ID NO: 14830 - RNA, 18 nt, artificial
  Chemically synthesized
cuuguugaggcauuuagc

SEQ ID NO: 14831 - RNA, 18 nt, artificial
  Chemically synthesized
uacuuggagauccggcaa

SEQ ID NO: 14832 - RNA, 18 nt, artificial
  Chemically synthesized
ugucucuguucuugaacg

SEQ ID NO: 14833 - RNA, 18 nt, artificial
  Chemically synthesized
acuucacagacacgucug

SEQ ID NO: 14834 - RNA, 18 nt, artificial
  Chemically synthesized
gaugugagcagggagccu

SEQ ID NO: 14835 - RNA, 18 nt, artificial
  Chemically synthesized
gcuccacuuucagccagg

SEQ ID NO: 14836 - RNA, 18 nt, artificial
  Chemically synthesized
ccucugcacaccgcccau

SEQ ID NO: 14837 - RNA, 18 nt, artificial
  Chemically synthesized
cgacgacgugcugcugga

SEQ ID NO: 14838 - RNA, 18 nt, artificial
  Chemically synthesized
agacucgccugagcagcu

SEQ ID NO: 14839 - RNA, 18 nt, artificial
  Chemically synthesized
cacugucugcgacuacac

SEQ ID NO: 14840 - RNA, 18 nt, artificial
  Chemically synthesized
uggugaagcauagcucug

SEQ ID NO: 14841 - RNA, 18 nt, artificial
  Chemically synthesized
ccagcagagccagcucag

SEQ ID NO: 14842 - RNA, 18 nt, artificial
  Chemically synthesized
ggacucgccuugccaagg

SEQ ID NO: 14843 - RNA, 18 nt, artificial
  Chemically synthesized
aguggcauguccacuugc

SEQ ID NO: 14844 - RNA, 18 nt, artificial
  Chemically synthesized
ccgcccauuccacuuccu

SEQ ID NO: 14845 - RNA, 18 nt, artificial
  Chemically synthesized
accagcagagccagcuca

SEQ ID NO: 14846 - RNA, 18 nt, artificial
  Chemically synthesized
ggcaccagcauacacacg

SEQ ID NO: 14847 - RNA, 18 nt, artificial
  Chemically synthesized
ugcugugaccacgacacu

SEQ ID NO: 14848 - RNA, 18 nt, artificial
  Chemically synthesized
ugaguacuuggagauccg

SEQ ID NO: 14849 - RNA, 18 nt, artificial
  Chemically synthesized
gcauagcucugggucucc

SEQ ID NO: 14850 - RNA, 18 nt, artificial
  Chemically synthesized
ggcagggcggcgcuucuc

SEQ ID NO: 14851 - RNA, 18 nt, artificial
  Chemically synthesized
uucucuugugucccuacu

SEQ ID NO: 14852 - RNA, 18 nt, artificial
  Chemically synthesized
ugucucugaugauuaccu

SEQ ID NO: 14853 - RNA, 18 nt, artificial
  Chemically synthesized
gaaagucccaucacugag

SEQ ID NO: 14854 - RNA, 18 nt, artificial
  Chemically synthesized
cugagccauucacacauc

SEQ ID NO: 14855 - RNA, 18 nt, artificial
  Chemically synthesized
ggccaccugcagagagcu

SEQ ID NO: 14856 - RNA, 18 nt, artificial
  Chemically synthesized
ugcuggagcugggaccca

SEQ ID NO: 14857 - RNA, 18 nt, artificial
  Chemically synthesized
ccuccuccuuucguugua

SEQ ID NO: 14858 - RNA, 18 nt, artificial
  Chemically synthesized
ugaugauuaccugcagag

SEQ ID NO: 14859 - RNA, 18 nt, artificial
  Chemically synthesized
agagacucgccugagcag

SEQ ID NO: 14860 - RNA, 18 nt, artificial
  Chemically synthesized
guucugaggcccugggug

SEQ ID NO: 14861 - RNA, 18 nt, artificial
  Chemically synthesized
gcucucaacaugcgagug

SEQ ID NO: 14862 - RNA, 18 nt, artificial
  Chemically synthesized
uuucacaccucccagcuu

SEQ ID NO: 14863 - RNA, 18 nt, artificial
  Chemically synthesized
auccggcaacuggagaca

SEQ ID NO: 14864 - RNA, 18 nt, artificial
  Chemically synthesized
cagcagcuggacaucaca

SEQ ID NO: 14865 - RNA, 18 nt, artificial
  Chemically synthesized
ucaucuauuccuuuucuc

SEQ ID NO: 14866 - RNA, 18 nt, artificial
  Chemically synthesized
aagccgauauuugccauu

SEQ ID NO: 14867 - RNA, 18 nt, artificial
  Chemically synthesized
caggaugccuguggucau

SEQ ID NO: 14868 - RNA, 18 nt, artificial
  Chemically synthesized
gacccuaggacccuaaau

SEQ ID NO: 14869 - RNA, 18 nt, artificial
  Chemically synthesized
cacuugaggagugggaug

SEQ ID NO: 14870 - RNA, 18 nt, artificial
  Chemically synthesized
cuugugggcacaugggca

SEQ ID NO: 14871 - RNA, 18 nt, artificial
  Chemically synthesized
gauuguagggcagggcgg

SEQ ID NO: 14872 - RNA, 18 nt, artificial
  Chemically synthesized
cacaucuucacccucagu

SEQ ID NO: 14873 - RNA, 18 nt, artificial
  Chemically synthesized
ugugugucugaccgcgau

SEQ ID NO: 14874 - RNA, 18 nt, artificial
  Chemically synthesized
ccaccugucaggaugccu

SEQ ID NO: 14875 - RNA, 18 nt, artificial
  Chemically synthesized
acuguaaugaugugagca

SEQ ID NO: 14876 - RNA, 18 nt, artificial
  Chemically synthesized
cucgagcugcuuaccaag

SEQ ID NO: 14877 - RNA, 18 nt, artificial
  Chemically synthesized
gggcauuuuaaagccauc

SEQ ID NO: 14878 - RNA, 18 nt, artificial
  Chemically synthesized
gcagugucccacggacag

SEQ ID NO: 14879 - RNA, 18 nt, artificial
  Chemically synthesized
uucauguccugcauggaa

SEQ ID NO: 14880 - RNA, 18 nt, artificial
  Chemically synthesized
ggagccuuccucccuggg

SEQ ID NO: 14881 - RNA, 18 nt, artificial
  Chemically synthesized
aauggugaagcauagcuc

SEQ ID NO: 14882 - RNA, 18 nt, artificial
  Chemically synthesized
uuccuauauccuggaaua

SEQ ID NO: 14883 - RNA, 18 nt, artificial
  Chemically synthesized
cuugggcugcuuuucauu

SEQ ID NO: 14884 - RNA, 18 nt, artificial
  Chemically synthesized
gauuaccugcagagcaag

SEQ ID NO: 14885 - RNA, 18 nt, artificial
  Chemically synthesized
gcagacacagcuguucuc

SEQ ID NO: 14886 - RNA, 18 nt, artificial
  Chemically synthesized
cagcauugaggaggauug

SEQ ID NO: 14887 - RNA, 18 nt, artificial
  Chemically synthesized
cugcccugaagacuguuc

SEQ ID NO: 14888 - RNA, 18 nt, artificial
  Chemically synthesized
ggccgacugcucgagcug

SEQ ID NO: 14889 - RNA, 18 nt, artificial
  Chemically synthesized
cugugaccacgacacugc

SEQ ID NO: 14890 - RNA, 18 nt, artificial
  Chemically synthesized
ucacugucugcgacuaca

SEQ ID NO: 14891 - RNA, 18 nt, artificial
  Chemically synthesized
gacucgccuugccaaggc

SEQ ID NO: 14892 - RNA, 18 nt, artificial
  Chemically synthesized
ccacaucacccgccucga

SEQ ID NO: 14893 - RNA, 18 nt, artificial
  Chemically synthesized
gugccgcaggagaaagag

SEQ ID NO: 14894 - RNA, 18 nt, artificial
  Chemically synthesized
ggccgacuggaccgcgcu

SEQ ID NO: 14895 - RNA, 18 nt, artificial
  Chemically synthesized
uauugcuagugagcucau

SEQ ID NO: 14896 - RNA, 18 nt, artificial
  Chemically synthesized
gacauccaguuugugcag

SEQ ID NO: 14897 - RNA, 18 nt, artificial
  Chemically synthesized
cacacacacaggcaccag

SEQ ID NO: 14898 - RNA, 18 nt, artificial
  Chemically synthesized
gcuuucccaccaacuuug

SEQ ID NO: 14899 - RNA, 18 nt, artificial
  Chemically synthesized
aaauggugaagcauagcu

SEQ ID NO: 14900 - RNA, 18 nt, artificial
  Chemically synthesized
caucaccacacuugauga

SEQ ID NO: 14901 - RNA, 18 nt, artificial
  Chemically synthesized
cccagcauugaggaggau

SEQ ID NO: 14902 - RNA, 18 nt, artificial
  Chemically synthesized
cauauaaaagccuccugc

SEQ ID NO: 14903 - RNA, 18 nt, artificial
  Chemically synthesized
acugagggagccuaacca

SEQ ID NO: 14904 - RNA, 18 nt, artificial
  Chemically synthesized
ggacuacaugcuggccac

SEQ ID NO: 14905 - RNA, 18 nt, artificial
  Chemically synthesized
cguuucgaugccuucauc

SEQ ID NO: 14906 - RNA, 18 nt, artificial
  Chemically synthesized
ucauguccugcauggaac

SEQ ID NO: 14907 - RNA, 18 nt, artificial
  Chemically synthesized
uccuaauggguccaccuc

SEQ ID NO: 14908 - RNA, 18 nt, artificial
  Chemically synthesized
agagagaggaagagagcu

SEQ ID NO: 14909 - RNA, 18 nt, artificial
  Chemically synthesized
cggcgcuucucggaaagc

SEQ ID NO: 14910 - RNA, 18 nt, artificial
  Chemically synthesized
caagcugggccgcgacga

SEQ ID NO: 14911 - RNA, 18 nt, artificial
  Chemically synthesized
caggacagacccuaggac

SEQ ID NO: 14912 - RNA, 18 nt, artificial
  Chemically synthesized
caugcuggccacugcugu

SEQ ID NO: 14913 - RNA, 18 nt, artificial
  Chemically synthesized
agccuuuacagguggccg

SEQ ID NO: 14914 - RNA, 18 nt, artificial
  Chemically synthesized
ugcucucagcuccaccug

SEQ ID NO: 14915 - RNA, 18 nt, artificial
  Chemically synthesized
ugagggagccuaaccaug

SEQ ID NO: 14916 - RNA, 18 nt, artificial
  Chemically synthesized
gcacaccgcccauuccac

SEQ ID NO: 14917 - RNA, 18 nt, artificial
  Chemically synthesized
ugucccacggacagcaga

SEQ ID NO: 14918 - RNA, 18 nt, artificial
  Chemically synthesized
uguaguccagcaacagcc

SEQ ID NO: 14919 - RNA, 18 nt, artificial
  Chemically synthesized
aaacauguagaagaugcc

SEQ ID NO: 14920 - RNA, 18 nt, artificial
  Chemically synthesized
uacccuugaggucucgag

SEQ ID NO: 14921 - RNA, 18 nt, artificial
  Chemically synthesized
uauauuccaggauauagg

SEQ ID NO: 14922 - RNA, 18 nt, artificial
  Chemically synthesized
auacuugaugaauaugcc

SEQ ID NO: 14923 - RNA, 18 nt, artificial
  Chemically synthesized
uagagcacagauuccucc

SEQ ID NO: 14924 - RNA, 18 nt, artificial
  Chemically synthesized
uguaaaggcuucucagcc

SEQ ID NO: 14925 - RNA, 18 nt, artificial
  Chemically synthesized
auacugguacauuggguc

SEQ ID NO: 14926 - RNA, 18 nt, artificial
  Chemically synthesized
uacucaaaguccaucucc

SEQ ID NO: 14927 - RNA, 18 nt, artificial
  Chemically synthesized
uaaucaucagagacaacc

SEQ ID NO: 14928 - RNA, 18 nt, artificial
  Chemically synthesized
aagugaggaaacugaggg

SEQ ID NO: 14929 - RNA, 18 nt, artificial
  Chemically synthesized
agacaaccaccaccaucc

SEQ ID NO: 14930 - RNA, 18 nt, artificial
  Chemically synthesized
uaaguagagcacagauuc

SEQ ID NO: 14931 - RNA, 18 nt, artificial
  Chemically synthesized
uaaauacugguacauugg

SEQ ID NO: 14932 - RNA, 18 nt, artificial
  Chemically synthesized
accauggcaccuucuccc

SEQ ID NO: 14933 - RNA, 18 nt, artificial
  Chemically synthesized
uccuucuuagucucagcu

SEQ ID NO: 14934 - RNA, 18 nt, artificial
  Chemically synthesized
gcuacucucuguucuccc

SEQ ID NO: 14935 - RNA, 18 nt, artificial
  Chemically synthesized
acauguagaagaugccuc

SEQ ID NO: 14936 - RNA, 18 nt, artificial
  Chemically synthesized
uugugucuccaguugccg

SEQ ID NO: 14937 - RNA, 18 nt, artificial
  Chemically synthesized
acagauacacacacaccc

SEQ ID NO: 14938 - RNA, 18 nt, artificial
  Chemically synthesized
uguccuggcugauaaucc

SEQ ID NO: 14939 - RNA, 18 nt, artificial
  Chemically synthesized
aaaacauguagaagaugc

SEQ ID NO: 14940 - RNA, 18 nt, artificial
  Chemically synthesized
agcucacuagcaauagac

SEQ ID NO: 14941 - RNA, 18 nt, artificial
  Chemically synthesized
aaauaaggcucaaggugg

SEQ ID NO: 14942 - RNA, 18 nt, artificial
  Chemically synthesized
aagguacaaaguuggugg

SEQ ID NO: 14943 - RNA, 18 nt, artificial
  Chemically synthesized
uguaugugagucuguaug

SEQ ID NO: 14944 - RNA, 18 nt, artificial
  Chemically synthesized
cuucuuagucucagcugg

SEQ ID NO: 14945 - RNA, 18 nt, artificial
  Chemically synthesized
uugagagguaaguagagc

SEQ ID NO: 14946 - RNA, 18 nt, artificial
  Chemically synthesized
uugccuuguacuugaugg

SEQ ID NO: 14947 - RNA, 18 nt, artificial
  Chemically synthesized
auucaaacacagcuacuc

SEQ ID NO: 14948 - RNA, 18 nt, artificial
  Chemically synthesized
guccuucuuagucucagc

SEQ ID NO: 14949 - RNA, 18 nt, artificial
  Chemically synthesized
uuuguaaggcaaucaagg

SEQ ID NO: 14950 - RNA, 18 nt, artificial
  Chemically synthesized
ugagugcaaauuuggucu

SEQ ID NO: 14951 - RNA, 18 nt, artificial
  Chemically synthesized
aauagaccagacacaggu

SEQ ID NO: 14952 - RNA, 18 nt, artificial
  Chemically synthesized
uacuuuuggcaauccucc

SEQ ID NO: 14953 - RNA, 18 nt, artificial
  Chemically synthesized
ugugagucuguaugugcc

SEQ ID NO: 14954 - RNA, 18 nt, artificial
  Chemically synthesized
agaaguacauggacaggc

SEQ ID NO: 14955 - RNA, 18 nt, artificial
  Chemically synthesized
agagguggacccauuagg

SEQ ID NO: 14956 - RNA, 18 nt, artificial
  Chemically synthesized
auuuggucuggaagucac

SEQ ID NO: 14957 - RNA, 18 nt, artificial
  Chemically synthesized
ucugugcuucauuagagg

SEQ ID NO: 14958 - RNA, 18 nt, artificial
  Chemically synthesized
ucaucagagacaaccacc

SEQ ID NO: 14959 - RNA, 18 nt, artificial
  Chemically synthesized
auuacagugacucauccc

SEQ ID NO: 14960 - RNA, 18 nt, artificial
  Chemically synthesized
aaucaagguacaaaguug

SEQ ID NO: 14961 - RNA, 18 nt, artificial
  Chemically synthesized
acgugucugugaaguugg

SEQ ID NO: 14962 - RNA, 18 nt, artificial
  Chemically synthesized
aaauuuggucuggaaguc

SEQ ID NO: 14963 - RNA, 18 nt, artificial
  Chemically synthesized
aaaggaauagaugagugc

SEQ ID NO: 14964 - RNA, 18 nt, artificial
  Chemically synthesized
uaugugagucuguaugug

SEQ ID NO: 14965 - RNA, 18 nt, artificial
  Chemically synthesized
caaauaucggcuuuucuc

SEQ ID NO: 14966 - RNA, 18 nt, artificial
  Chemically synthesized
aaggaauagaugagugcc

SEQ ID NO: 14967 - RNA, 18 nt, artificial
  Chemically synthesized
uccaaguacucaaagucc

SEQ ID NO: 14968 - RNA, 18 nt, artificial
  Chemically synthesized
ucuccaggaauugagagg

SEQ ID NO: 14969 - RNA, 18 nt, artificial
  Chemically synthesized
aguacucaaaguccaucu

SEQ ID NO: 14970 - RNA, 18 nt, artificial
  Chemically synthesized
uguaugugcccaugugcc

SEQ ID NO: 14971 - RNA, 18 nt, artificial
  Chemically synthesized
ucacuagcaauagaccag

SEQ ID NO: 14972 - RNA, 18 nt, artificial
  Chemically synthesized
cauuaggaaauaaggcuc

SEQ ID NO: 14973 - RNA, 18 nt, artificial
  Chemically synthesized
aaauaucggcuuuucuca

SEQ ID NO: 14974 - RNA, 18 nt, artificial
  Chemically synthesized
agaauggcaaauaucggc

SEQ ID NO: 14975 - RNA, 18 nt, artificial
  Chemically synthesized
caaccaccaccauccggc

SEQ ID NO: 14976 - RNA, 18 nt, artificial
  Chemically synthesized
aucaagguacaaaguugg

SEQ ID NO: 14977 - RNA, 18 nt, artificial
  Chemically synthesized
uagcaauagaccagacac

SEQ ID NO: 14978 - RNA, 18 nt, artificial
  Chemically synthesized
gacaugccacucacagcc

SEQ ID NO: 14979 - RNA, 18 nt, artificial
  Chemically synthesized
ucagaacagucuucaggg

SEQ ID NO: 14980 - RNA, 18 nt, artificial
  Chemically synthesized
aaguacucaaaguccauc

SEQ ID NO: 14981 - RNA, 18 nt, artificial
  Chemically synthesized
uaaaggcuucucagccuc

SEQ ID NO: 14982 - RNA, 18 nt, artificial
  Chemically synthesized
uugucugccagcgcuucc

SEQ ID NO: 14983 - RNA, 18 nt, artificial
  Chemically synthesized
acacugcugucuacagcg

SEQ ID NO: 14984 - RNA, 18 nt, artificial
  Chemically synthesized
uagaccagacacaggugc

SEQ ID NO: 14985 - RNA, 18 nt, artificial
  Chemically synthesized
aggaauagaugagugccc

SEQ ID NO: 14986 - RNA, 18 nt, artificial
  Chemically synthesized
ugugucugcaguucauug

SEQ ID NO: 14987 - RNA, 18 nt, artificial
  Chemically synthesized
acucuuucuucauugccu

SEQ ID NO: 14988 - RNA, 18 nt, artificial
  Chemically synthesized
cugagugcaaauuugguc

SEQ ID NO: 14989 - RNA, 18 nt, artificial
  Chemically synthesized
aucccuucucaugccagg

SEQ ID NO: 14990 - RNA, 18 nt, artificial
  Chemically synthesized
ucuccugcacaaacugga

SEQ ID NO: 14991 - RNA, 18 nt, artificial
  Chemically synthesized
acaucauuacagugacuc

SEQ ID NO: 14992 - RNA, 18 nt, artificial
  Chemically synthesized
aauaucggcuuuucucag

SEQ ID NO: 14993 - RNA, 18 nt, artificial
  Chemically synthesized
uccaguugccggaucucc

SEQ ID NO: 14994 - RNA, 18 nt, artificial
  Chemically synthesized
acccauuaggaaauaagg

SEQ ID NO: 14995 - RNA, 18 nt, artificial
  Chemically synthesized
gacccauuaggaaauaag

SEQ ID NO: 14996 - RNA, 18 nt, artificial
  Chemically synthesized
aacucuuucuucauugcc

SEQ ID NO: 14997 - RNA, 18 nt, artificial
  Chemically synthesized
ucaagugaggaaacugag

SEQ ID NO: 14998 - RNA, 18 nt, artificial
  Chemically synthesized
cucagaacagucuucagg

SEQ ID NO: 14999 - RNA, 18 nt, artificial
  Chemically synthesized
ugugaaguuggcaucucc

SEQ ID NO: 15000 - RNA, 18 nt, artificial
  Chemically synthesized
aaaugcccaguauuaaag

SEQ ID NO: 15001 - RNA, 18 nt, artificial
  Chemically synthesized
aaguccaucuccuccgcc

SEQ ID NO: 15002 - RNA, 18 nt, artificial
  Chemically synthesized
uaccuagaaaaacgugug

SEQ ID NO: 15003 - RNA, 18 nt, artificial
  Chemically synthesized
aauacugguacauugggu

SEQ ID NO: 15004 - RNA, 18 nt, artificial
  Chemically synthesized
accuguaaaggcuucuca

SEQ ID NO: 15005 - RNA, 18 nt, artificial
  Chemically synthesized
agguauaaauacugguac

SEQ ID NO: 15006 - RNA, 18 nt, artificial
  Chemically synthesized
acuguggaagaagcugcc

SEQ ID NO: 15007 - RNA, 18 nt, artificial
  Chemically synthesized
ugcccuacaaucuggagc

SEQ ID NO: 15008 - RNA, 18 nt, artificial
  Chemically synthesized
ucuccaaguacucaaagu

SEQ ID NO: 15009 - RNA, 18 nt, artificial
  Chemically synthesized
aggaucccuucucaugcc

SEQ ID NO: 15010 - RNA, 18 nt, artificial
  Chemically synthesized
cuugugucuccaguugcc

SEQ ID NO: 15011 - RNA, 18 nt, artificial
  Chemically synthesized
aguagagcacagauuccu

SEQ ID NO: 15012 - RNA, 18 nt, artificial
  Chemically synthesized
uguucuauaguguccugg

SEQ ID NO: 15013 - RNA, 18 nt, artificial
  Chemically synthesized
ccauuaggaaauaaggcu

SEQ ID NO: 15014 - RNA, 18 nt, artificial
  Chemically synthesized
agccaagccuggucuccc

SEQ ID NO: 15015 - RNA, 18 nt, artificial
  Chemically synthesized
uaugugugugucuguaug

SEQ ID NO: 15016 - RNA, 18 nt, artificial
  Chemically synthesized
aucagucgcuucugaugg

SEQ ID NO: 15017 - RNA, 18 nt, artificial
  Chemically synthesized
agcgcuuccucuuucucc

SEQ ID NO: 15018 - RNA, 18 nt, artificial
  Chemically synthesized
ucuuuucgaugagcucac

SEQ ID NO: 15019 - RNA, 18 nt, artificial
  Chemically synthesized
ucuguacauauaugugug

SEQ ID NO: 15020 - RNA, 18 nt, artificial
  Chemically synthesized
caggaucccuucucaugc

SEQ ID NO: 15021 - RNA, 18 nt, artificial
  Chemically synthesized
aggaugcaagauauauuc

SEQ ID NO: 15022 - RNA, 18 nt, artificial
  Chemically synthesized
uuuaagcagcucucuucc

SEQ ID NO: 15023 - RNA, 18 nt, artificial
  Chemically synthesized
caaacuggaugucgcugg

SEQ ID NO: 15024 - RNA, 18 nt, artificial
  Chemically synthesized
cugguccuucuuagucuc

SEQ ID NO: 15025 - RNA, 18 nt, artificial
  Chemically synthesized
cuguaaaggcuucucagc

SEQ ID NO: 15026 - RNA, 18 nt, artificial
  Chemically synthesized
acugaagcaucaguaggc

SEQ ID NO: 15027 - RNA, 18 nt, artificial
  Chemically synthesized
aaagaugcagaugagagg

SEQ ID NO: 15028 - RNA, 18 nt, artificial
  Chemically synthesized
uguagaagaugccucuug

SEQ ID NO: 15029 - RNA, 18 nt, artificial
  Chemically synthesized
gcaucuccaggaauugag

SEQ ID NO: 15030 - RNA, 18 nt, artificial
  Chemically synthesized
aagguaccuugcuccagc

SEQ ID NO: 15031 - RNA, 18 nt, artificial
  Chemically synthesized
uacugguacauugggucc

SEQ ID NO: 15032 - RNA, 18 nt, artificial
  Chemically synthesized
uaugcuucaccauuuccu

SEQ ID NO: 15033 - RNA, 18 nt, artificial
  Chemically synthesized
ugugugucuguaugugag

SEQ ID NO: 15034 - RNA, 18 nt, artificial
  Chemically synthesized
agaacucauacuugauga

SEQ ID NO: 15035 - RNA, 18 nt, artificial
  Chemically synthesized
ugaguagggacacaagag

SEQ ID NO: 15036 - RNA, 18 nt, artificial
  Chemically synthesized
caggauauaggaagaaug

SEQ ID NO: 15037 - RNA, 18 nt, artificial
  Chemically synthesized
aaguauaaauugcucugg

SEQ ID NO: 15038 - RNA, 18 nt, artificial
  Chemically synthesized
agcuacucucuguucucc

SEQ ID NO: 15039 - RNA, 18 nt, artificial
  Chemically synthesized
ugucuguacauauaugug

SEQ ID NO: 15040 - RNA, 18 nt, artificial
  Chemically synthesized
uggaagucacauuccuug

SEQ ID NO: 15041 - RNA, 18 nt, artificial
  Chemically synthesized
uucagucgauaguuuguc

SEQ ID NO: 15042 - RNA, 18 nt, artificial
  Chemically synthesized
aauugagagguaaguaga

SEQ ID NO: 15043 - RNA, 18 nt, artificial
  Chemically synthesized
aagucacauuccuugcuc

SEQ ID NO: 15044 - RNA, 18 nt, artificial
  Chemically synthesized
aauccuccucaaugcugg

SEQ ID NO: 15045 - RNA, 18 nt, artificial
  Chemically synthesized
uaaauugcucugggaagg

SEQ ID NO: 15046 - RNA, 18 nt, artificial
  Chemically synthesized
ucaaaguccaucuccucc

SEQ ID NO: 15047 - RNA, 18 nt, artificial
  Chemically synthesized
aagaugugugaauggcuc

SEQ ID NO: 15048 - RNA, 18 nt, artificial
  Chemically synthesized
uuuccgagaagcgccgcc

SEQ ID NO: 15049 - RNA, 18 nt, artificial
  Chemically synthesized
aaagcucucugcaggugg

SEQ ID NO: 15050 - RNA, 18 nt, artificial
  Chemically synthesized
ugaaccucaggaugcugg

SEQ ID NO: 15051 - RNA, 18 nt, artificial
  Chemically synthesized
augcugggucccagcucc

SEQ ID NO: 15052 - RNA, 18 nt, artificial
  Chemically synthesized
uugguaagcagcucgagc

SEQ ID NO: 15053 - RNA, 18 nt, artificial
  Chemically synthesized
gaauugagagguaaguag

SEQ ID NO: 15054 - RNA, 18 nt, artificial
  Chemically synthesized
uaguuugucuguuccagu

SEQ ID NO: 15055 - RNA, 18 nt, artificial
  Chemically synthesized
ucagagacaaccaccacc

SEQ ID NO: 15056 - RNA, 18 nt, artificial
  Chemically synthesized
acugcugucuacagcggc

SEQ ID NO: 15057 - RNA, 18 nt, artificial
  Chemically synthesized
uucuuagucucagcuggu

SEQ ID NO: 15058 - RNA, 18 nt, artificial
  Chemically synthesized
acaagaucaugcagagag

SEQ ID NO: 15059 - RNA, 18 nt, artificial
  Chemically synthesized
ucaaguguggugaugccc

SEQ ID NO: 15060 - RNA, 18 nt, artificial
  Chemically synthesized
ugcauggcagcuaaaugc

SEQ ID NO: 15061 - RNA, 18 nt, artificial
  Chemically synthesized
gaccauggcaccuucucc

SEQ ID NO: 15062 - RNA, 18 nt, artificial
  Chemically synthesized
uuucgcuuuccgagaagc

SEQ ID NO: 15063 - RNA, 18 nt, artificial
  Chemically synthesized
aucuccugcacaaacugg

SEQ ID NO: 15064 - RNA, 18 nt, artificial
  Chemically synthesized
aucuccaaguacucaaag

SEQ ID NO: 15065 - RNA, 18 nt, artificial
  Chemically synthesized
aguggagcaaagauaugc

SEQ ID NO: 15066 - RNA, 18 nt, artificial
  Chemically synthesized
augagugcccaauuuuug

SEQ ID NO: 15067 - RNA, 18 nt, artificial
  Chemically synthesized
ucugcugguccuucuuag

SEQ ID NO: 15068 - RNA, 18 nt, artificial
  Chemically synthesized
acuugucacugcugaagg

SEQ ID NO: 15069 - RNA, 18 nt, artificial
  Chemically synthesized
agagaacagcugugucug

SEQ ID NO: 15070 - RNA, 18 nt, artificial
  Chemically synthesized
cauucccucccaagaucc

SEQ ID NO: 15071 - RNA, 18 nt, artificial
  Chemically synthesized
gaaaagguaccuugcucc

SEQ ID NO: 15072 - RNA, 18 nt, artificial
  Chemically synthesized
ugcaagauauauuccagg

SEQ ID NO: 15073 - RNA, 18 nt, artificial
  Chemically synthesized
acagcuacucucuguucu

SEQ ID NO: 15074 - RNA, 18 nt, artificial
  Chemically synthesized
aauuuggucuggaaguca

SEQ ID NO: 15075 - RNA, 18 nt, artificial
  Chemically synthesized
aaaaggaauagaugagug

SEQ ID NO: 15076 - RNA, 18 nt, artificial
  Chemically synthesized
cucacagccacugguucc

SEQ ID NO: 15077 - RNA, 18 nt, artificial
  Chemically synthesized
uucucagccuccuccugc

SEQ ID NO: 15078 - RNA, 18 nt, artificial
  Chemically synthesized
gcaacagccagcucuccc

SEQ ID NO: 15079 - RNA, 18 nt, artificial
  Chemically synthesized
aaacugagggugaagaug

SEQ ID NO: 15080 - RNA, 18 nt, artificial
  Chemically synthesized
aagaauggcaaauaucgg

SEQ ID NO: 15081 - RNA, 18 nt, artificial
  Chemically synthesized
ucuccuccgccagcgcgg

SEQ ID NO: 15082 - RNA, 18 nt, artificial
  Chemically synthesized
aaacacagcuacucucug

SEQ ID NO: 15083 - RNA, 18 nt, artificial
  Chemically synthesized
gcacguucaagaacagag

SEQ ID NO: 15084 - RNA, 18 nt, artificial
  Chemically synthesized
cauguagaagaugccucu

SEQ ID NO: 15085 - RNA, 18 nt, artificial
  Chemically synthesized
uaccuugcuccagccugg

SEQ ID NO: 15086 - RNA, 18 nt, artificial
  Chemically synthesized
ucucccgcagccaagccu

SEQ ID NO: 15087 - RNA, 18 nt, artificial
  Chemically synthesized
gacacugcugucuacagc

SEQ ID NO: 15088 - RNA, 18 nt, artificial
  Chemically synthesized
cucacuagcaauagacca

SEQ ID NO: 15089 - RNA, 18 nt, artificial
  Chemically synthesized
agaaccaagauuuggugc

SEQ ID NO: 15090 - RNA, 18 nt, artificial
  Chemically synthesized
caccuguaaaggcuucuc

SEQ ID NO: 15091 - RNA, 18 nt, artificial
  Chemically synthesized
guucaagaacagagacag

SEQ ID NO: 15092 - RNA, 18 nt, artificial
  Chemically synthesized
aaugccucaacaagauca

SEQ ID NO: 15093 - RNA, 18 nt, artificial
  Chemically synthesized
uaggcaucacuguggaag

SEQ ID NO: 15094 - RNA, 18 nt, artificial
  Chemically synthesized
uuucaaugaguagggaca

SEQ ID NO: 15095 - RNA, 18 nt, artificial
  Chemically synthesized
ccuguaaaggcuucucag

SEQ ID NO: 15096 - RNA, 18 nt, artificial
  Chemically synthesized
cagaugagagguggaccc

SEQ ID NO: 15097 - RNA, 18 nt, artificial
  Chemically synthesized
gucuggaagucacauucc

SEQ ID NO: 15098 - RNA, 18 nt, artificial
  Chemically synthesized
uacauauauguguguguc

SEQ ID NO: 15099 - RNA, 18 nt, artificial
  Chemically synthesized
uucaaacacagcuacucu

SEQ ID NO: 15100 - RNA, 18 nt, artificial
  Chemically synthesized
gauauaggaagaauggca

SEQ ID NO: 15101 - RNA, 18 nt, artificial
  Chemically synthesized
acguguguaugcuggugc

SEQ ID NO: 15102 - RNA, 18 nt, artificial
  Chemically synthesized
acacacacaacuucaguc

SEQ ID NO: 15103 - RNA, 18 nt, artificial
  Chemically synthesized
cagccuggcugaaagugg

SEQ ID NO: 15104 - RNA, 18 nt, artificial
  Chemically synthesized
ggcuucucagccuccucc

SEQ ID NO: 15105 - RNA, 18 nt, artificial
  Chemically synthesized
uuugucuguuccaguugc

SEQ ID NO: 15106 - RNA, 18 nt, artificial
  Chemically synthesized
augcaagauauauuccag

SEQ ID NO: 15107 - RNA, 18 nt, artificial
  Chemically synthesized
aguauaaauugcucuggg

SEQ ID NO: 15108 - RNA, 18 nt, artificial
  Chemically synthesized
acaugaaaugugaugucc

SEQ ID NO: 15109 - RNA, 18 nt, artificial
  Chemically synthesized
aggcugagugcaaauuug

SEQ ID NO: 15110 - RNA, 18 nt, artificial
  Chemically synthesized
agacagugaugaaccuca

SEQ ID NO: 15111 - RNA, 18 nt, artificial
  Chemically synthesized
ggaacucuuucuucauug

SEQ ID NO: 15112 - RNA, 18 nt, artificial
  Chemically synthesized
auuaggaaauaaggcuca

SEQ ID NO: 15113 - RNA, 18 nt, artificial
  Chemically synthesized
ugugugagaguacauguc

SEQ ID NO: 15114 - RNA, 18 nt, artificial
  Chemically synthesized
ucgauaguuugucuguuc

SEQ ID NO: 15115 - RNA, 18 nt, artificial
  Chemically synthesized
ugucugugaaguuggcau

SEQ ID NO: 15116 - RNA, 18 nt, artificial
  Chemically synthesized
cucaggcgagucucuugg

SEQ ID NO: 15117 - RNA, 18 nt, artificial
  Chemically synthesized
gcuugugucuccaguugc

SEQ ID NO: 15118 - RNA, 18 nt, artificial
  Chemically synthesized
ucauuacagugacucauc

SEQ ID NO: 15119 - RNA, 18 nt, artificial
  Chemically synthesized
gaaauaaggcucaaggug

SEQ ID NO: 15120 - RNA, 18 nt, artificial
  Chemically synthesized
guacucaaaguccaucuc

SEQ ID NO: 15121 - RNA, 18 nt, artificial
  Chemically synthesized
agaacagcugugucugca

SEQ ID NO: 15122 - RNA, 18 nt, artificial
  Chemically synthesized
auguugagagcagccagg

SEQ ID NO: 15123 - RNA, 18 nt, artificial
  Chemically synthesized
auaguuugucuguuccag

SEQ ID NO: 15124 - RNA, 18 nt, artificial
  Chemically synthesized
uucauugccuuguacuug

SEQ ID NO: 15125 - RNA, 18 nt, artificial
  Chemically synthesized
ugugucuguaugugaguc

SEQ ID NO: 15126 - RNA, 18 nt, artificial
  Chemically synthesized
auggcucagagcugagcu

SEQ ID NO: 15127 - RNA, 18 nt, artificial
  Chemically synthesized
aaugcccaguauuaaagg

SEQ ID NO: 15128 - RNA, 18 nt, artificial
  Chemically synthesized
aucuccaggaauugagag

SEQ ID NO: 15129 - RNA, 18 nt, artificial
  Chemically synthesized
auccuaagaaaagguacc

SEQ ID NO: 15130 - RNA, 18 nt, artificial
  Chemically synthesized
agaccauggcaccuucuc

SEQ ID NO: 15131 - RNA, 18 nt, artificial
  Chemically synthesized
gucuccuugggcugggcc

SEQ ID NO: 15132 - RNA, 18 nt, artificial
  Chemically synthesized
ugugugugagaguacaug

SEQ ID NO: 15133 - RNA, 18 nt, artificial
  Chemically synthesized
caacagccagcucucccg

SEQ ID NO: 15134 - RNA, 18 nt, artificial
  Chemically synthesized
uaagcagcucgagcaguc

SEQ ID NO: 15135 - RNA, 18 nt, artificial
  Chemically synthesized
ucuacccuugaggucucg

SEQ ID NO: 15136 - RNA, 18 nt, artificial
  Chemically synthesized
uuuggucuggaagucaca

SEQ ID NO: 15137 - RNA, 18 nt, artificial
  Chemically synthesized
agaguacaugucuguaca

SEQ ID NO: 15138 - RNA, 18 nt, artificial
  Chemically synthesized
uaugcuggugccugugug

SEQ ID NO: 15139 - RNA, 18 nt, artificial
  Chemically synthesized
augaaggcaucgaaacgc

SEQ ID NO: 15140 - RNA, 18 nt, artificial
  Chemically synthesized
agauacacacacacccag

SEQ ID NO: 15141 - RNA, 18 nt, artificial
  Chemically synthesized
agacagauacacacacac

SEQ ID NO: 15142 - RNA, 18 nt, artificial
  Chemically synthesized
cauauaugugugugucug

SEQ ID NO: 15143 - RNA, 18 nt, artificial
  Chemically synthesized
ucaguaggcaucacugug

SEQ ID NO: 15144 - RNA, 18 nt, artificial
  Chemically synthesized
ucaucuccugcacaaacu

SEQ ID NO: 15145 - RNA, 18 nt, artificial
  Chemically synthesized
uggaaaugaaaagcagcc

SEQ ID NO: 15146 - RNA, 18 nt, artificial
  Chemically synthesized
gcucacuagcaauagacc

SEQ ID NO: 15147 - RNA, 18 nt, artificial
  Chemically synthesized
aaaacguguguaugcugg

SEQ ID NO: 15148 - RNA, 18 nt, artificial
  Chemically synthesized
aggccaggaucccuucuc

SEQ ID NO: 15149 - RNA, 18 nt, artificial
  Chemically synthesized
ucgcggucagacacacac

SEQ ID NO: 15150 - RNA, 18 nt, artificial
  Chemically synthesized
caucacuguggaagaagc

SEQ ID NO: 15151 - RNA, 18 nt, artificial
  Chemically synthesized
cagcuacucucuguucuc

SEQ ID NO: 15152 - RNA, 18 nt, artificial
  Chemically synthesized
ucugcaguucauuguugu

SEQ ID NO: 15153 - RNA, 18 nt, artificial
  Chemically synthesized
agcuugguaagcagcucg

SEQ ID NO: 15154 - RNA, 18 nt, artificial
  Chemically synthesized
aguccagaaccaagauuu

SEQ ID NO: 15155 - RNA, 18 nt, artificial
  Chemically synthesized
ugaguuuaagcagcucuc

SEQ ID NO: 15156 - RNA, 18 nt, artificial
  Chemically synthesized
uugugugaguuuaagcag

SEQ ID NO: 15157 - RNA, 18 nt, artificial
  Chemically synthesized
acugcugaagguugggca

SEQ ID NO: 15158 - RNA, 18 nt, artificial
  Chemically synthesized
uacagaggcgccagggcg

SEQ ID NO: 15159 - RNA, 18 nt, artificial
  Chemically synthesized
cagccacugguuccaugc

SEQ ID NO: 15160 - RNA, 18 nt, artificial
  Chemically synthesized
ugaugaaccucaggaugc

SEQ ID NO: 15161 - RNA, 18 nt, artificial
  Chemically synthesized
gaucccuucucaugccag

SEQ ID NO: 15162 - RNA, 18 nt, artificial
  Chemically synthesized
aggcuuuuauauggucgc

SEQ ID NO: 15163 - RNA, 18 nt, artificial
  Chemically synthesized
uuuccagaguuugguuuc

SEQ ID NO: 15164 - RNA, 18 nt, artificial
  Chemically synthesized
aaugugauguccagcugc

SEQ ID NO: 15165 - RNA, 18 nt, artificial
  Chemically synthesized
auugagagguaaguagag

SEQ ID NO: 15166 - RNA, 18 nt, artificial
  Chemically synthesized
ugugugugucuguaugug

SEQ ID NO: 15167 - RNA, 18 nt, artificial
  Chemically synthesized
aaacgcucaggcauaugc

SEQ ID NO: 15168 - RNA, 18 nt, artificial
  Chemically synthesized
agggauucaaacacagcu

SEQ ID NO: 15169 - RNA, 18 nt, artificial
  Chemically synthesized
cccauuaggaaauaaggc

SEQ ID NO: 15170 - RNA, 18 nt, artificial
  Chemically synthesized
ucuccaguugccggaucu

SEQ ID NO: 15171 - RNA, 18 nt, artificial
  Chemically synthesized
ugucuguaugugagucug

SEQ ID NO: 15172 - RNA, 18 nt, artificial
  Chemically synthesized
cuugcuccagccuggcug

SEQ ID NO: 15173 - RNA, 18 nt, artificial
  Chemically synthesized
ucuguaugugagucugua

SEQ ID NO: 15174 - RNA, 18 nt, artificial
  Chemically synthesized
guugguguagucgcagac

SEQ ID NO: 15175 - RNA, 18 nt, artificial
  Chemically synthesized
guuucaaugaguagggac

SEQ ID NO: 15176 - RNA, 18 nt, artificial
  Chemically synthesized
guuuaagcagcucucuuc

SEQ ID NO: 15177 - RNA, 18 nt, artificial
  Chemically synthesized
auacacacacacccaggg

SEQ ID NO: 15178 - RNA, 18 nt, artificial
  Chemically synthesized
ucucuuccucucucugug

SEQ ID NO: 15179 - RNA, 18 nt, artificial
  Chemically synthesized
aaaguccaucuccuccgc

SEQ ID NO: 15180 - RNA, 18 nt, artificial
  Chemically synthesized
caauuuuuguucagggac

SEQ ID NO: 15181 - RNA, 18 nt, artificial
  Chemically synthesized
ugugagaguacaugucug

SEQ ID NO: 15182 - RNA, 18 nt, artificial
  Chemically synthesized
ugauaauccagcaagugg

SEQ ID NO: 15183 - RNA, 18 nt, artificial
  Chemically synthesized
aaaggaggaggcagggca

SEQ ID NO: 15184 - RNA, 18 nt, artificial
  Chemically synthesized
ugcaggacaugaaaugug

SEQ ID NO: 15185 - RNA, 18 nt, artificial
  Chemically synthesized
ucccuucucaugccaggu

SEQ ID NO: 15186 - RNA, 18 nt, artificial
  Chemically synthesized
aaacuggaugucgcuggg

SEQ ID NO: 15187 - RNA, 18 nt, artificial
  Chemically synthesized
uccuguucuauagugucc

SEQ ID NO: 15188 - RNA, 18 nt, artificial
  Chemically synthesized
acaugguuaggcucccuc

SEQ ID NO: 15189 - RNA, 18 nt, artificial
  Chemically synthesized
cugagagcaugaccacag

SEQ ID NO: 15190 - RNA, 18 nt, artificial
  Chemically synthesized
agugcccaauuuuuguuc

SEQ ID NO: 15191 - RNA, 18 nt, artificial
  Chemically synthesized
uccgcacguucaagaaca

SEQ ID NO: 15192 - RNA, 18 nt, artificial
  Chemically synthesized
ugcacaaacuggaugucg

SEQ ID NO: 15193 - RNA, 18 nt, artificial
  Chemically synthesized
ucgcauguugagagcagc

SEQ ID NO: 15194 - RNA, 18 nt, artificial
  Chemically synthesized
gaauggcaaauaucggcu

SEQ ID NO: 15195 - RNA, 18 nt, artificial
  Chemically synthesized
uacuugaugaauaugcca

SEQ ID NO: 15196 - RNA, 18 nt, artificial
  Chemically synthesized
aucacuguggaagaagcu

SEQ ID NO: 15197 - RNA, 18 nt, artificial
  Chemically synthesized
aguugccggaucaucucc

SEQ ID NO: 15198 - RNA, 18 nt, artificial
  Chemically synthesized
aauagaugagugcccaau

SEQ ID NO: 15199 - RNA, 18 nt, artificial
  Chemically synthesized
ccuucucaugccaggugg

SEQ ID NO: 15200 - RNA, 18 nt, artificial
  Chemically synthesized
aaaguuggugggaaagcu

SEQ ID NO: 15201 - RNA, 18 nt, artificial
  Chemically synthesized
agucuucagggcagggac

SEQ ID NO: 15202 - RNA, 18 nt, artificial
  Chemically synthesized
augaauaugccagaggcc

SEQ ID NO: 15203 - RNA, 18 nt, artificial
  Chemically synthesized
aucaucagagacaaccac

SEQ ID NO: 15204 - RNA, 18 nt, artificial
  Chemically synthesized
uauacuuuuggcaauccu

SEQ ID NO: 15205 - RNA, 18 nt, artificial
  Chemically synthesized
agcuggcucugcuggucc

SEQ ID NO: 15206 - RNA, 18 nt, artificial
  Chemically synthesized
ugaaaugugauguccagc

SEQ ID NO: 15207 - RNA, 18 nt, artificial
  Chemically synthesized
aaguuggcaucuccagga

SEQ ID NO: 15208 - RNA, 18 nt, artificial
  Chemically synthesized
uugaugaauaugccagag

SEQ ID NO: 15209 - RNA, 18 nt, artificial
  Chemically synthesized
uccgcuugugucuccagu

SEQ ID NO: 15210 - RNA, 18 nt, artificial
  Chemically synthesized
agaugaaggcaucgaaac

SEQ ID NO: 15211 - RNA, 18 nt, artificial
  Chemically synthesized
ccaccucuacccuugagg

SEQ ID NO: 15212 - RNA, 18 nt, artificial
  Chemically synthesized
uagaaaaacguguguaug

SEQ ID NO: 15213 - RNA, 18 nt, artificial
  Chemically synthesized
aauaaggcucaagguggg

SEQ ID NO: 15214 - RNA, 18 nt, artificial
  Chemically synthesized
gaagaauggcaaauaucg

SEQ ID NO: 15215 - RNA, 18 nt, artificial
  Chemically synthesized
aaguuggugggaaagcuc

SEQ ID NO: 15216 - RNA, 18 nt, artificial
  Chemically synthesized
cggcuuucgcuuuccgag

SEQ ID NO: 15217 - RNA, 18 nt, artificial
  Chemically synthesized
cccuugaggucucgaggc

SEQ ID NO: 15218 - RNA, 18 nt, artificial
  Chemically synthesized
uuggugggaaagcucucu

SEQ ID NO: 15219 - RNA, 18 nt, artificial
  Chemically synthesized
ugcugguccuucuuaguc

SEQ ID NO: 15220 - RNA, 18 nt, artificial
  Chemically synthesized
gaaggaggaaguggaaug

SEQ ID NO: 15221 - RNA, 18 nt, artificial
  Chemically synthesized
acuucagucgauaguuug

SEQ ID NO: 15222 - RNA, 18 nt, artificial
  Chemically synthesized
gcaauagcagaugaaggc

SEQ ID NO: 15223 - RNA, 18 nt, artificial
  Chemically synthesized
uaucggcuuuucucagau

SEQ ID NO: 15224 - RNA, 18 nt, artificial
  Chemically synthesized
auggcagcuaaaugccuc

SEQ ID NO: 15225 - RNA, 18 nt, artificial
  Chemically synthesized
uuagucucagcugguccu

SEQ ID NO: 15226 - RNA, 18 nt, artificial
  Chemically synthesized
ccagagcuaugcuucacc

SEQ ID NO: 15227 - RNA, 18 nt, artificial
  Chemically synthesized
uguugagagcagccaggg

SEQ ID NO: 15228 - RNA, 18 nt, artificial
  Chemically synthesized
cagaguuugguuucaaug

SEQ ID NO: 15229 - RNA, 18 nt, artificial
  Chemically synthesized
guagagcacagauuccuc

SEQ ID NO: 15230 - RNA, 18 nt, artificial
  Chemically synthesized
aauggcucagagcugagc

SEQ ID NO: 15231 - RNA, 18 nt, artificial
  Chemically synthesized
augccucuugagauggcu

SEQ ID NO: 15232 - RNA, 18 nt, artificial
  Chemically synthesized
auauacuuuuggcaaucc

SEQ ID NO: 15233 - RNA, 18 nt, artificial
  Chemically synthesized
gcuguaccuagaaaaacg

SEQ ID NO: 15234 - RNA, 18 nt, artificial
  Chemically synthesized
agaacagucuucagggca

SEQ ID NO: 15235 - RNA, 18 nt, artificial
  Chemically synthesized
ucucugugcuucauuaga

SEQ ID NO: 15236 - RNA, 18 nt, artificial
  Chemically synthesized
ucgcauugucugccagcg

SEQ ID NO: 15237 - RNA, 18 nt, artificial
  Chemically synthesized
uagaagaugccucuugag

SEQ ID NO: 15238 - RNA, 18 nt, artificial
  Chemically synthesized
aucaucuccugcacaaac

SEQ ID NO: 15239 - RNA, 18 nt, artificial
  Chemically synthesized
ccggaucuccaaguacuc

SEQ ID NO: 15240 - RNA, 18 nt, artificial
  Chemically synthesized
uacacacacacccagggc

SEQ ID NO: 15241 - RNA, 18 nt, artificial
  Chemically synthesized
gagcugagagcaugacca

SEQ ID NO: 15242 - RNA, 18 nt, artificial
  Chemically synthesized
ucacauuccuugcucugc

SEQ ID NO: 15243 - RNA, 18 nt, artificial
  Chemically synthesized
augcccaguauuaaaggg

SEQ ID NO: 15244 - RNA, 18 nt, artificial
  Chemically synthesized
aguucauuguugugugag

SEQ ID NO: 15245 - RNA, 18 nt, artificial
  Chemically synthesized
gcacucgcauguugagag

SEQ ID NO: 15246 - RNA, 18 nt, artificial
  Chemically synthesized
ugcagguaaucaucagag

SEQ ID NO: 15247 - RNA, 18 nt, artificial
  Chemically synthesized
gcacagacaccuaagacc

SEQ ID NO: 15248 - RNA, 18 nt, artificial
  Chemically synthesized
ugaaguuggcaucuccag

SEQ ID NO: 15249 - RNA, 18 nt, artificial
  Chemically synthesized
guacauuggguccuuucc

SEQ ID NO: 15250 - RNA, 18 nt, artificial
  Chemically synthesized
ugcaguucauuguugugu

SEQ ID NO: 15251 - RNA, 18 nt, artificial
  Chemically synthesized
gaacucuuucuucauugc

SEQ ID NO: 15252 - RNA, 18 nt, artificial
  Chemically synthesized
ucacuguggaagaagcug

SEQ ID NO: 15253 - RNA, 18 nt, artificial
  Chemically synthesized
caugucuguacauauaug

SEQ ID NO: 15254 - RNA, 18 nt, artificial
  Chemically synthesized
cuaagaaaagguaccuug

SEQ ID NO: 15255 - RNA, 18 nt, artificial
  Chemically synthesized
gcaauagaccagacacag

SEQ ID NO: 15256 - RNA, 18 nt, artificial
  Chemically synthesized
ucuguaugugcccaugug

SEQ ID NO: 15257 - RNA, 18 nt, artificial
  Chemically synthesized
aucauuacagugacucau

SEQ ID NO: 15258 - RNA, 18 nt, artificial
  Chemically synthesized
uaagaaaagguaccuugc

SEQ ID NO: 15259 - RNA, 18 nt, artificial
  Chemically synthesized
uggacaugccacucacag

SEQ ID NO: 15260 - RNA, 18 nt, artificial
  Chemically synthesized
ucgcagacagugaugaac

SEQ ID NO: 15261 - RNA, 18 nt, artificial
  Chemically synthesized
aaugaguagggacacaag

SEQ ID NO: 15262 - RNA, 18 nt, artificial
  Chemically synthesized
auguaguccagcaacagc

SEQ ID NO: 15263 - RNA, 18 nt, artificial
  Chemically synthesized
aggcuucucagccuccuc

SEQ ID NO: 15264 - RNA, 18 nt, artificial
  Chemically synthesized
ggcugagugcaaauuugg

SEQ ID NO: 15265 - RNA, 18 nt, artificial
  Chemically synthesized
gagagaacagcugugucu

SEQ ID NO: 15266 - RNA, 18 nt, artificial
  Chemically synthesized
agauggcuuuaaaaugcc

SEQ ID NO: 15267 - RNA, 18 nt, artificial
  Chemically synthesized
aauuuuuguucagggaca

SEQ ID NO: 15268 - RNA, 18 nt, artificial
  Chemically synthesized
aggauauaggaagaaugg

SEQ ID NO: 15269 - RNA, 18 nt, artificial
  Chemically synthesized
cucuuucuucauugccuu

SEQ ID NO: 15270 - RNA, 18 nt, artificial
  Chemically synthesized
uuucuccugcggcacccg

SEQ ID NO: 15271 - RNA, 18 nt, artificial
  Chemically synthesized
caaauuuggucuggaagu

SEQ ID NO: 15272 - RNA, 18 nt, artificial
  Chemically synthesized
gaggaaguggaaugggcg

SEQ ID NO: 15273 - RNA, 18 nt, artificial
  Chemically synthesized
caauagaccagacacagg

SEQ ID NO: 15274 - RNA, 18 nt, artificial
  Chemically synthesized
ggcaaucaagguacaaag

SEQ ID NO: 15275 - RNA, 18 nt, artificial
  Chemically synthesized
aacgcucaggcauaugcc

SEQ ID NO: 15276 - RNA, 18 nt, artificial
  Chemically synthesized
aagaucaugcagagaggg

SEQ ID NO: 15277 - RNA, 18 nt, artificial
  Chemically synthesized
gacccagagcuaugcuuc

SEQ ID NO: 15278 - RNA, 18 nt, artificial
  Chemically synthesized
ucaacaagaucaugcaga

SEQ ID NO: 15279 - RNA, 18 nt, artificial
  Chemically synthesized
uugggcugggccaaacug

SEQ ID NO: 15280 - RNA, 18 nt, artificial
  Chemically synthesized
uacauuggguccuuucca

SEQ ID NO: 15281 - RNA, 18 nt, artificial
  Chemically synthesized
ugaagaugugugaauggc

SEQ ID NO: 15282 - RNA, 18 nt, artificial
  Chemically synthesized
caucaguaggcaucacug

SEQ ID NO: 15283 - RNA, 18 nt, artificial
  Chemically synthesized
uuugguuucaaugaguag

SEQ ID NO: 15284 - RNA, 18 nt, artificial
  Chemically synthesized
uuucuucauugccuugua

SEQ ID NO: 15285 - RNA, 18 nt, artificial
  Chemically synthesized
uuuuggcaauccuccuca

SEQ ID NO: 15286 - RNA, 18 nt, artificial
  Chemically synthesized
agagcaugaccacaggca

SEQ ID NO: 15287 - RNA, 18 nt, artificial
  Chemically synthesized
gaugcaagauauauucca

SEQ ID NO: 15288 - RNA, 18 nt, artificial
  Chemically synthesized
ucuggaagucacauuccu

SEQ ID NO: 15289 - RNA, 18 nt, artificial
  Chemically synthesized
agguaccuugcuccagcc

SEQ ID NO: 15290 - RNA, 18 nt, artificial
  Chemically synthesized
agacaccuaagaccaugg

SEQ ID NO: 15291 - RNA, 18 nt, artificial
  Chemically synthesized
agacacacacaacuucag

SEQ ID NO: 15292 - RNA, 18 nt, artificial
  Chemically synthesized
uggagagaggcugagugc

SEQ ID NO: 15293 - RNA, 18 nt, artificial
  Chemically synthesized
caaauaacuuuguaaggc

SEQ ID NO: 15294 - RNA, 18 nt, artificial
  Chemically synthesized
ugugaauggcucagagcu

SEQ ID NO: 15295 - RNA, 18 nt, artificial
  Chemically synthesized
aguggacaugccacucac

SEQ ID NO: 15296 - RNA, 18 nt, artificial
  Chemically synthesized
ugcccaccucuacccuug

SEQ ID NO: 15297 - RNA, 18 nt, artificial
  Chemically synthesized
cacacacaacuucagucg

SEQ ID NO: 15298 - RNA, 18 nt, artificial
  Chemically synthesized
ggucuccuugggcugggc

SEQ ID NO: 15299 - RNA, 18 nt, artificial
  Chemically synthesized
ggaggaaguggaaugggc

SEQ ID NO: 15300 - RNA, 18 nt, artificial
  Chemically synthesized
ugagggugaagaugugug

SEQ ID NO: 15301 - RNA, 18 nt, artificial
  Chemically synthesized
uccagaaccaagauuugg

SEQ ID NO: 15302 - RNA, 18 nt, artificial
  Chemically synthesized
aacugagggugaagaugu

SEQ ID NO: 15303 - RNA, 18 nt, artificial
  Chemically synthesized
aagguugggcagaagcug

SEQ ID NO: 15304 - RNA, 18 nt, artificial
  Chemically synthesized
agagagggagagaacagc

SEQ ID NO: 15305 - RNA, 18 nt, artificial
  Chemically synthesized
gauacacacacacccagg

SEQ ID NO: 15306 - RNA, 18 nt, artificial
  Chemically synthesized
agaaaaggaauagaugag

SEQ ID NO: 15307 - RNA, 18 nt, artificial
  Chemically synthesized
aagaacagagacaggcgg

SEQ ID NO: 15308 - RNA, 18 nt, artificial
  Chemically synthesized
ugcguacaaaacauguag

SEQ ID NO: 15309 - RNA, 18 nt, artificial
  Chemically synthesized
ugccacucacagccacug

SEQ ID NO: 15310 - RNA, 18 nt, artificial
  Chemically synthesized
ugugaaagaugcagauga

SEQ ID NO: 15311 - RNA, 18 nt, artificial
  Chemically synthesized
accucuuuucgaugagcu

SEQ ID NO: 15312 - RNA, 18 nt, artificial
  Chemically synthesized
cagauuccuccuacaacg

SEQ ID NO: 15313 - RNA, 18 nt, artificial
  Chemically synthesized
gcguaagaaguaggaauc

SEQ ID NO: 15314 - RNA, 18 nt, artificial
  Chemically synthesized
aaaguggagcaaagauau

SEQ ID NO: 15315 - RNA, 18 nt, artificial
  Chemically synthesized
aaggaggaaguggaaugg

SEQ ID NO: 15316 - RNA, 18 nt, artificial
  Chemically synthesized
auagaccagacacaggug

SEQ ID NO: 15317 - RNA, 18 nt, artificial
  Chemically synthesized
cuacagggauucaaacac

SEQ ID NO: 15318 - RNA, 18 nt, artificial
  Chemically synthesized
gugaggaaacugagggug

SEQ ID NO: 15319 - RNA, 18 nt, artificial
  Chemically synthesized
ucucagcugguccuguuc

SEQ ID NO: 15320 - RNA, 18 nt, artificial
  Chemically synthesized
uucagggcagggacaagg

SEQ ID NO: 15321 - RNA, 18 nt, artificial
  Chemically synthesized
agagaaaaggaauagaug

SEQ ID NO: 15322 - RNA, 18 nt, artificial
  Chemically synthesized
guaaguagagcacagauu

SEQ ID NO: 15323 - RNA, 18 nt, artificial
  Chemically synthesized
gagguaaguagagcacag

SEQ ID NO: 15324 - RNA, 18 nt, artificial
  Chemically synthesized
aaggcuucucagccuccu

SEQ ID NO: 15325 - RNA, 18 nt, artificial
  Chemically synthesized
cugcuucaagauauacuu

SEQ ID NO: 15326 - RNA, 18 nt, artificial
  Chemically synthesized
aaugggcggugugcagag

SEQ ID NO: 15327 - RNA, 18 nt, artificial
  Chemically synthesized
ucuuucuccugcggcacc

SEQ ID NO: 15328 - RNA, 18 nt, artificial
  Chemically synthesized
gcaccuggagagaggcug

SEQ ID NO: 15329 - RNA, 18 nt, artificial
  Chemically synthesized
agcugugucugcaguuca

SEQ ID NO: 15330 - RNA, 18 nt, artificial
  Chemically synthesized
cuuuguaaggcaaucaag

SEQ ID NO: 15331 - RNA, 18 nt, artificial
  Chemically synthesized
uugccggaucaucuccug

SEQ ID NO: 15332 - RNA, 18 nt, artificial
  Chemically synthesized
cucaagugaggaaacuga

SEQ ID NO: 15333 - RNA, 18 nt, artificial
  Chemically synthesized
guacaugucuguacauau

SEQ ID NO: 15334 - RNA, 18 nt, artificial
  Chemically synthesized
agaugccucuugagaugg

SEQ ID NO: 15335 - RNA, 18 nt, artificial
  Chemically synthesized
agagggagagaacagcug

SEQ ID NO: 15336 - RNA, 18 nt, artificial
  Chemically synthesized
aaaugugauguccagcug

SEQ ID NO: 15337 - RNA, 18 nt, artificial
  Chemically synthesized
gcgcuuccucuuucuccu

SEQ ID NO: 15338 - RNA, 18 nt, artificial
  Chemically synthesized
agucuguaugugcccaug

SEQ ID NO: 15339 - RNA, 18 nt, artificial
  Chemically synthesized
ccacugguuccaugcagg

SEQ ID NO: 15340 - RNA, 18 nt, artificial
  Chemically synthesized
caugcaggacaugaaaug

SEQ ID NO: 15341 - RNA, 18 nt, artificial
  Chemically synthesized
ucguggucacagcagugg

SEQ ID NO: 15342 - RNA, 18 nt, artificial
  Chemically synthesized
aucaaguguggugaugcc

SEQ ID NO: 15343 - RNA, 18 nt, artificial
  Chemically synthesized
auuggguccuuuccagag

SEQ ID NO: 15344 - RNA, 18 nt, artificial
  Chemically synthesized
cuugaggucucgaggcgg

SEQ ID NO: 15345 - RNA, 18 nt, artificial
  Chemically synthesized
uguacauauaugugugug

SEQ ID NO: 15346 - RNA, 18 nt, artificial
  Chemically synthesized
ucaggcgagucucuuggg

SEQ ID NO: 15347 - RNA, 18 nt, artificial
  Chemically synthesized
uuguugugugaguuuaag

SEQ ID NO: 15348 - RNA, 18 nt, artificial
  Chemically synthesized
accuguguccgcacguuc

SEQ ID NO: 15349 - RNA, 18 nt, artificial
  Chemically synthesized
guugccggaucaucuccu

SEQ ID NO: 15350 - RNA, 18 nt, artificial
  Chemically synthesized
ucucucugugcuucauua

SEQ ID NO: 15351 - RNA, 18 nt, artificial
  Chemically synthesized
cagccaagccuggucucc

SEQ ID NO: 15352 - RNA, 18 nt, artificial
  Chemically synthesized
uaaacucaggaugcaaga

SEQ ID NO: 15353 - RNA, 18 nt, artificial
  Chemically synthesized
agguugggcagaagcugg

SEQ ID NO: 15354 - RNA, 18 nt, artificial
  Chemically synthesized
cuccuacaacgaaaggag

SEQ ID NO: 15355 - RNA, 18 nt, artificial
  Chemically synthesized
ucugggaaggagagaggg

SEQ ID NO: 15356 - RNA, 18 nt, artificial
  Chemically synthesized
auugcucugggaaggaga

SEQ ID NO: 15357 - RNA, 18 nt, artificial
  Chemically synthesized
ucagagcugagcuggcuc

SEQ ID NO: 15358 - RNA, 18 nt, artificial
  Chemically synthesized
cuggagagaggcugagug

SEQ ID NO: 15359 - RNA, 18 nt, artificial
  Chemically synthesized
ugaagguugggcagaagc

SEQ ID NO: 15360 - RNA, 18 nt, artificial
  Chemically synthesized
acuagcaauagaccagac

SEQ ID NO: 15361 - RNA, 18 nt, artificial
  Chemically synthesized
ccucuacccuugaggucu

SEQ ID NO: 15362 - RNA, 18 nt, artificial
  Chemically synthesized
ugggaaggagagagggag

SEQ ID NO: 15363 - RNA, 18 nt, artificial
  Chemically synthesized
uucucaugccagguggag

SEQ ID NO: 15364 - RNA, 18 nt, artificial
  Chemically synthesized
ucgcuucugaugggcacc

SEQ ID NO: 15365 - RNA, 18 nt, artificial
  Chemically synthesized
uuuuuguucagggacaug

SEQ ID NO: 15366 - RNA, 18 nt, artificial
  Chemically synthesized
aacauguagaagaugccu

SEQ ID NO: 15367 - RNA, 18 nt, artificial
  Chemically synthesized
uugggcagaagcugggag

SEQ ID NO: 15368 - RNA, 18 nt, artificial
  Chemically synthesized
agcccaagcugcucaggc

SEQ ID NO: 15369 - RNA, 18 nt, artificial
  Chemically synthesized
gcccagggaggaaggcuc

SEQ ID NO: 15370 - RNA, 18 nt, artificial
  Chemically synthesized
cacugaagcaucaguagg

SEQ ID NO: 15371 - RNA, 18 nt, artificial
  Chemically synthesized
uucuauaguguccuggcu

SEQ ID NO: 15372 - RNA, 18 nt, artificial
  Chemically synthesized
agggaggaaggcucccug

SEQ ID NO: 15373 - RNA, 18 nt, artificial
  Chemically synthesized
aaagguaccuugcuccag

SEQ ID NO: 15374 - RNA, 18 nt, artificial
  Chemically synthesized
gacagauacacacacacc

SEQ ID NO: 15375 - RNA, 18 nt, artificial
  Chemically synthesized
uccuuuccagaguuuggu

SEQ ID NO: 15376 - RNA, 18 nt, artificial
  Chemically synthesized
agaaaagguaccuugcuc

SEQ ID NO: 15377 - RNA, 18 nt, artificial
  Chemically synthesized
aggcguccagcagccugc

SEQ ID NO: 15378 - RNA, 18 nt, artificial
  Chemically synthesized
caccuaagaccauggcac

SEQ ID NO: 15379 - RNA, 18 nt, artificial
  Chemically synthesized
ugucuacagcggccaccu

SEQ ID NO: 15380 - RNA, 18 nt, artificial
  Chemically synthesized
ugagcucacuagcaauag

SEQ ID NO: 15381 - RNA, 18 nt, artificial
  Chemically synthesized
agaacagagacaggcggc

SEQ ID NO: 15382 - RNA, 18 nt, artificial
  Chemically synthesized
acgcucaggcauaugccc

SEQ ID NO: 15383 - RNA, 18 nt, artificial
  Chemically synthesized
gaggcuuuuauauggucg

SEQ ID NO: 15384 - RNA, 18 nt, artificial
  Chemically synthesized
uugaggucucgaggcggg

SEQ ID NO: 15385 - RNA, 18 nt, artificial
  Chemically synthesized
guaccuugcuccagccug

SEQ ID NO: 15386 - RNA, 18 nt, artificial
  Chemically synthesized
aggugugaaagaugcaga

SEQ ID NO: 15387 - RNA, 18 nt, artificial
  Chemically synthesized
cuuccucuuucuccugcg

SEQ ID NO: 15388 - RNA, 18 nt, artificial
  Chemically synthesized
cauguugagagcagccag

SEQ ID NO: 15389 - RNA, 18 nt, artificial
  Chemically synthesized
agacgugucugugaaguu

SEQ ID NO: 15390 - RNA, 18 nt, artificial
  Chemically synthesized
auauaugugugugucugu

SEQ ID NO: 15391 - RNA, 18 nt, artificial
  Chemically synthesized
uggccagcauguagucca

SEQ ID NO: 15392 - RNA, 18 nt, artificial
  Chemically synthesized
augaguagggacacaaga

SEQ ID NO: 15393 - RNA, 18 nt, artificial
  Chemically synthesized
ucugcagguaaucaucag

SEQ ID NO: 15394 - RNA, 18 nt, artificial
  Chemically synthesized
gaacagcugugucugcag

SEQ ID NO: 15395 - RNA, 18 nt, artificial
  Chemically synthesized
uauaugugugugucugua

SEQ ID NO: 15396 - RNA, 18 nt, artificial
  Chemically synthesized
ggcuuuucucagauaucu

SEQ ID NO: 15397 - RNA, 18 nt, artificial
  Chemically synthesized
cccaauuuuuguucaggg

SEQ ID NO: 15398 - RNA, 18 nt, artificial
  Chemically synthesized
ugugcuucauuagaggua

SEQ ID NO: 15399 - RNA, 18 nt, artificial
  Chemically synthesized
acguucaagaacagagac

SEQ ID NO: 15400 - RNA, 18 nt, artificial
  Chemically synthesized
cagaacucauacuugaug

SEQ ID NO: 15401 - RNA, 18 nt, artificial
  Chemically synthesized
agaguuugguuucaauga

SEQ ID NO: 15402 - RNA, 18 nt, artificial
  Chemically synthesized
cagaggacagccugaggg

SEQ ID NO: 15403 - RNA, 18 nt, artificial
  Chemically synthesized
agagguaaguagagcaca

SEQ ID NO: 15404 - RNA, 18 nt, artificial
  Chemically synthesized
auagcagaugaaggcauc

SEQ ID NO: 15405 - RNA, 18 nt, artificial
  Chemically synthesized
gcaucgaaacgcucaggc

SEQ ID NO: 15406 - RNA, 18 nt, artificial
  Chemically synthesized
agucacauuccuugcucu

SEQ ID NO: 15407 - RNA, 18 nt, artificial
  Chemically synthesized
ggaucuccaaguacucaa

SEQ ID NO: 15408 - RNA, 18 nt, artificial
  Chemically synthesized
uaaaugccucaacaagau

SEQ ID NO: 15409 - RNA, 18 nt, artificial
  Chemically synthesized
uauggucgcuguuuguaa

SEQ ID NO: 15410 - RNA, 18 nt, artificial
  Chemically synthesized
uggcucugcugguccuuc

SEQ ID NO: 15411 - RNA, 18 nt, artificial
  Chemically synthesized
acucacagccacugguuc

SEQ ID NO: 15412 - RNA, 18 nt, artificial
  Chemically synthesized
cugucuacagcggccacc

SEQ ID NO: 15413 - RNA, 18 nt, artificial
  Chemically synthesized
uaugugcccaugugccca

SEQ ID NO: 15414 - RNA, 18 nt, artificial
  Chemically synthesized
ucagacacacacaacuuc

SEQ ID NO: 15415 - RNA, 18 nt, artificial
  Chemically synthesized
ucgggucgcauugucugc

SEQ ID NO: 15416 - RNA, 18 nt, artificial
  Chemically synthesized
guacaaaacauguagaag

SEQ ID NO: 15417 - RNA, 18 nt, artificial
  Chemically synthesized
gggugcccaccucuaccc

SEQ ID NO: 15418 - RNA, 18 nt, artificial
  Chemically synthesized
aauagcagaugaaggcau

SEQ ID NO: 15419 - RNA, 18 nt, artificial
  Chemically synthesized
aguccaucuccuccgcca

SEQ ID NO: 15420 - RNA, 18 nt, artificial
  Chemically synthesized
agugcaaauuuggucugg

SEQ ID NO: 15421 - RNA, 18 nt, artificial
  Chemically synthesized
ugggcggugugcagaggc

SEQ ID NO: 15422 - RNA, 18 nt, artificial
  Chemically synthesized
cagaaccaagauuuggug

SEQ ID NO: 15423 - RNA, 18 nt, artificial
  Chemically synthesized
uucauuguugugugaguu

SEQ ID NO: 15424 - RNA, 18 nt, artificial
  Chemically synthesized
aacagccagcucucccgc

SEQ ID NO: 15425 - RNA, 18 nt, artificial
  Chemically synthesized
agcaacagccagcucucc

SEQ ID NO: 15426 - RNA, 18 nt, artificial
  Chemically synthesized
gagguauaaauacuggua

SEQ ID NO: 15427 - RNA, 18 nt, artificial
  Chemically synthesized
cuccagccuggcugaaag

SEQ ID NO: 15428 - RNA, 18 nt, artificial
  Chemically synthesized
aucuccuccgccagcgcg

SEQ ID NO: 15429 - RNA, 18 nt, artificial
  Chemically synthesized
cagcaacagccagcucuc

SEQ ID NO: 15430 - RNA, 18 nt, artificial
  Chemically synthesized
ucggcuuuucucagauau

SEQ ID NO: 15431 - RNA, 18 nt, artificial
  Chemically synthesized
ugguccuucuuagucuca

SEQ ID NO: 15432 - RNA, 18 nt, artificial
  Chemically synthesized
ucagugaugggacuuucc

SEQ ID NO: 15433 - RNA, 18 nt, artificial
  Chemically synthesized
cucuacccuugaggucuc

SEQ ID NO: 15434 - RNA, 18 nt, artificial
  Chemically synthesized
gaggugugaaagaugcag

SEQ ID NO: 15435 - RNA, 18 nt, artificial
  Chemically synthesized
ugguccuguucuauagug

SEQ ID NO: 15436 - RNA, 18 nt, artificial
  Chemically synthesized
aagcugcucaggcgaguc

SEQ ID NO: 15437 - RNA, 18 nt, artificial
  Chemically synthesized
agcuguaccuagaaaaac

SEQ ID NO: 15438 - RNA, 18 nt, artificial
  Chemically synthesized
cguccagcagccugccag

SEQ ID NO: 15439 - RNA, 18 nt, artificial
  Chemically synthesized
ucuccuugggcugggcca

SEQ ID NO: 15440 - RNA, 18 nt, artificial
  Chemically synthesized
gggacaugguuaggcucc

SEQ ID NO: 15441 - RNA, 18 nt, artificial
  Chemically synthesized
caaggcgaguccagaacc

SEQ ID NO: 15442 - RNA, 18 nt, artificial
  Chemically synthesized
uugucacugcugaagguu

SEQ ID NO: 15443 - RNA, 18 nt, artificial
  Chemically synthesized
aagcucucugcagguggc

SEQ ID NO: 15444 - RNA, 18 nt, artificial
  Chemically synthesized
gugaugggacuuucccac

SEQ ID NO: 15445 - RNA, 18 nt, artificial
  Chemically synthesized
aggacaugaaaugugaug

SEQ ID NO: 15446 - RNA, 18 nt, artificial
  Chemically synthesized
acucaggaugcaagauau

SEQ ID NO: 15447 - RNA, 18 nt, artificial
  Chemically synthesized
guccgcuugugucuccag

SEQ ID NO: 15448 - RNA, 18 nt, artificial
  Chemically synthesized
ggcguaagaaguaggaau

SEQ ID NO: 15449 - RNA, 18 nt, artificial
  Chemically synthesized
uguaccuagaaaaacgug

SEQ ID NO: 15450 - RNA, 18 nt, artificial
  Chemically synthesized
aaugcugggucccagcuc

SEQ ID NO: 15451 - RNA, 18 nt, artificial
  Chemically synthesized
ggaugcaagauauauucc

SEQ ID NO: 15452 - RNA, 18 nt, artificial
  Chemically synthesized
ugugugaauggcucagag

SEQ ID NO: 15453 - RNA, 18 nt, artificial
  Chemically synthesized
cugcucacaucauuacag

SEQ ID NO: 15454 - RNA, 18 nt, artificial
  Chemically synthesized
acugguuccaugcaggac

SEQ ID NO: 15455 - RNA, 18 nt, artificial
  Chemically synthesized
acagagacaggcggcgcc

SEQ ID NO: 15456 - RNA, 18 nt, artificial
  Chemically synthesized
aucaguaggcaucacugu

SEQ ID NO: 15457 - RNA, 18 nt, artificial
  Chemically synthesized
augguuaggcucccucag

SEQ ID NO: 15458 - RNA, 18 nt, artificial
  Chemically synthesized
ugucugcaguucauuguu

SEQ ID NO: 15459 - RNA, 18 nt, artificial
  Chemically synthesized
guccuguucuauaguguc

SEQ ID NO: 15460 - RNA, 18 nt, artificial
  Chemically synthesized
uuccucuuucuccugcgg

SEQ ID NO: 15461 - RNA, 18 nt, artificial
  Chemically synthesized
uggcucagagcugagcug

SEQ ID NO: 15462 - RNA, 18 nt, artificial
  Chemically synthesized
ucaaugcugggucccagc

SEQ ID NO: 15463 - RNA, 18 nt, artificial
  Chemically synthesized
aauugcucugggaaggag

SEQ ID NO: 15464 - RNA, 18 nt, artificial
  Chemically synthesized
gcugcucaggcgagucuc

SEQ ID NO: 15465 - RNA, 18 nt, artificial
  Chemically synthesized
ugggccaaacugcuuccc

SEQ ID NO: 15466 - RNA, 18 nt, artificial
  Chemically synthesized
ggguccgcuugugucucc

SEQ ID NO: 15467 - RNA, 18 nt, artificial
  Chemically synthesized
gaguuugguuucaaugag

SEQ ID NO: 15468 - RNA, 18 nt, artificial
  Chemically synthesized
ggguaaaguauaaauugc

SEQ ID NO: 15469 - RNA, 18 nt, artificial
  Chemically synthesized
uguguccgcacguucaag

SEQ ID NO: 15470 - RNA, 18 nt, artificial
  Chemically synthesized
ugggaggugugaaagaug

SEQ ID NO: 15471 - RNA, 18 nt, artificial
  Chemically synthesized
acagccacugguuccaug

SEQ ID NO: 15472 - RNA, 18 nt, artificial
  Chemically synthesized
auuccuugcucugcaggu

SEQ ID NO: 15473 - RNA, 18 nt, artificial
  Chemically synthesized
cucucccgcagccaagcc

SEQ ID NO: 15474 - RNA, 18 nt, artificial
  Chemically synthesized
ucacaucauuacagugac

SEQ ID NO: 15475 - RNA, 18 nt, artificial
  Chemically synthesized
augccagguggagcugag

SEQ ID NO: 15476 - RNA, 18 nt, artificial
  Chemically synthesized
uacagggauucaaacaca

SEQ ID NO: 15477 - RNA, 18 nt, artificial
  Chemically synthesized
gggucuccuugggcuggg

SEQ ID NO: 15478 - RNA, 18 nt, artificial
  Chemically synthesized
aaaaacguguguaugcug

SEQ ID NO: 15479 - RNA, 18 nt, artificial
  Chemically synthesized
auugccuuguacuugaug

SEQ ID NO: 15480 - RNA, 18 nt, artificial
  Chemically synthesized
uaguccagcaacagccag

SEQ ID NO: 15481 - RNA, 18 nt, artificial
  Chemically synthesized
cagggacaaggccuuggc

SEQ ID NO: 15482 - RNA, 18 nt, artificial
  Chemically synthesized
accucuacccuugagguc

SEQ ID NO: 15483 - RNA, 18 nt, artificial
  Chemically synthesized
ugagucuguaugugccca

SEQ ID NO: 15484 - RNA, 18 nt, artificial
  Chemically synthesized
augccacucacagccacu

SEQ ID NO: 15485 - RNA, 18 nt, artificial
  Chemically synthesized
acacagcuacucucuguu

SEQ ID NO: 15486 - RNA, 18 nt, artificial
  Chemically synthesized
aaguggacaugccacuca

SEQ ID NO: 15487 - RNA, 18 nt, artificial
  Chemically synthesized
uccuggcugauaauccag

SEQ ID NO: 15488 - RNA, 18 nt, artificial
  Chemically synthesized
uugcucugggaaggagag

SEQ ID NO: 15489 - RNA, 18 nt, artificial
  Chemically synthesized
ggauauaggaagaauggc

SEQ ID NO: 15490 - RNA, 18 nt, artificial
  Chemically synthesized
ugaugggacuuucccacc

SEQ ID NO: 15491 - RNA, 18 nt, artificial
  Chemically synthesized
aaguguggugaugcccgc

SEQ ID NO: 15492 - RNA, 18 nt, artificial
  Chemically synthesized
cuagcaauagaccagaca

SEQ ID NO: 15493 - RNA, 18 nt, artificial
  Chemically synthesized
gaagucacauuccuugcu

SEQ ID NO: 15494 - RNA, 18 nt, artificial
  Chemically synthesized
agaagcgccgcccugccc

SEQ ID NO: 15495 - RNA, 18 nt, artificial
  Chemically synthesized
auagaugagugcccaauu

SEQ ID NO: 15496 - RNA, 18 nt, artificial
  Chemically synthesized
agaugcagaugagaggug

SEQ ID NO: 15497 - RNA, 18 nt, artificial
  Chemically synthesized
ugaaggcaucgaaacgcu

SEQ ID NO: 15498 - RNA, 18 nt, artificial
  Chemically synthesized
augaaaugugauguccag

SEQ ID NO: 15499 - RNA, 18 nt, artificial
  Chemically synthesized
aggacaucgcggucagac

SEQ ID NO: 15500 - RNA, 18 nt, artificial
  Chemically synthesized
agcucucccgcagccaag

SEQ ID NO: 15501 - RNA, 18 nt, artificial
  Chemically synthesized
ucuuucuucauugccuug

SEQ ID NO: 15502 - RNA, 18 nt, artificial
  Chemically synthesized
auugucugccagcgcuuc

SEQ ID NO: 15503 - RNA, 18 nt, artificial
  Chemically synthesized
cagguaaucaucagagac

SEQ ID NO: 15504 - RNA, 18 nt, artificial
  Chemically synthesized
agcugagcuggcucugcu

SEQ ID NO: 15505 - RNA, 18 nt, artificial
  Chemically synthesized
ccagguggagcugagagc

SEQ ID NO: 15506 - RNA, 18 nt, artificial
  Chemically synthesized
uagaugagugcccaauuu

SEQ ID NO: 15507 - RNA, 18 nt, artificial
  Chemically synthesized
gguccuggagccucagcg

SEQ ID NO: 15508 - RNA, 18 nt, artificial
  Chemically synthesized
cagcugugucugcaguuc

SEQ ID NO: 15509 - RNA, 18 nt, artificial
  Chemically synthesized
uccugcacaaacuggaug

SEQ ID NO: 15510 - RNA, 18 nt, artificial
  Chemically synthesized
augugcccacaagcuuug

SEQ ID NO: 15511 - RNA, 18 nt, artificial
  Chemically synthesized
uaacuuuguaaggcaauc

SEQ ID NO: 15512 - RNA, 18 nt, artificial
  Chemically synthesized
gaaccaagauuuggugca

SEQ ID NO: 15513 - RNA, 18 nt, artificial
  Chemically synthesized
guccagcaacagccagcu

SEQ ID NO: 15514 - RNA, 18 nt, artificial
  Chemically synthesized
gcaugaccacaggcaucc

SEQ ID NO: 15515 - RNA, 18 nt, artificial
  Chemically synthesized
gacgugucugugaaguug

SEQ ID NO: 15516 - RNA, 18 nt, artificial
  Chemically synthesized
cagugucguggucacagc

SEQ ID NO: 15517 - RNA, 18 nt, artificial
  Chemically synthesized
aguguggugaugcccgcc

SEQ ID NO: 15518 - RNA, 18 nt, artificial
  Chemically synthesized
ucccugccaggcguccag

SEQ ID NO: 15519 - RNA, 18 nt, artificial
  Chemically synthesized
aucagagacaaccaccac

SEQ ID NO: 15520 - RNA, 18 nt, artificial
  Chemically synthesized
ccuugaggucucgaggcg

SEQ ID NO: 15521 - RNA, 18 nt, artificial
  Chemically synthesized
cucccucagugaugggac

SEQ ID NO: 15522 - RNA, 18 nt, artificial
  Chemically synthesized
aauaugccagaggccagg

SEQ ID NO: 15523 - RNA, 18 nt, artificial
  Chemically synthesized
uguguaugcuggugccug

SEQ ID NO: 15524 - RNA, 18 nt, artificial
  Chemically synthesized
agggacaugguuaggcuc

SEQ ID NO: 15525 - RNA, 18 nt, artificial
  Chemically synthesized
aagggaggauguggagga

SEQ ID NO: 15526 - RNA, 18 nt, artificial
  Chemically synthesized
augccucaacaagaucau

SEQ ID NO: 15527 - RNA, 18 nt, artificial
  Chemically synthesized
agacccagagcuaugcuu

SEQ ID NO: 15528 - RNA, 18 nt, artificial
  Chemically synthesized
agggccucagaacagucu

SEQ ID NO: 15529 - RNA, 18 nt, artificial
  Chemically synthesized
cagggauucaaacacagc

SEQ ID NO: 15530 - RNA, 18 nt, artificial
  Chemically synthesized
agaugugugaauggcuca

SEQ ID NO: 15531 - RNA, 18 nt, artificial
  Chemically synthesized
ucucgaggcgggugaugu

SEQ ID NO: 15532 - RNA, 18 nt, artificial
  Chemically synthesized
cagggaggaaggcucccu

SEQ ID NO: 15533 - RNA, 18 nt, artificial
  Chemically synthesized
cagaggcacugaagcauc

SEQ ID NO: 15534 - RNA, 18 nt, artificial
  Chemically synthesized
cugguuccaugcaggaca

SEQ ID NO: 15535 - RNA, 18 nt, artificial
  Chemically synthesized
ccaggaucccuucucaug

SEQ ID NO: 15536 - RNA, 18 nt, artificial
  Chemically synthesized
ugagugcccaauuuuugu

SEQ ID NO: 15537 - RNA, 18 nt, artificial
  Chemically synthesized
cauguaguccagcaacag

SEQ ID NO: 15538 - RNA, 18 nt, artificial
  Chemically synthesized
gaugcagaugagaggugg

SEQ ID NO: 15539 - RNA, 18 nt, artificial
  Chemically synthesized
uguccagcugcugcagac

SEQ ID NO: 15540 - RNA, 18 nt, artificial
  Chemically synthesized
auaauccagcaaguggac

SEQ ID NO: 15541 - RNA, 18 nt, artificial
  Chemically synthesized
auaucggcuuuucucaga

SEQ ID NO: 15542 - RNA, 18 nt, artificial
  Chemically synthesized
uuccugggagcuguaccu

SEQ ID NO: 15543 - RNA, 18 nt, artificial
  Chemically synthesized
aggcagacagauacacac

SEQ ID NO: 15544 - RNA, 18 nt, artificial
  Chemically synthesized
cugggccaaacugcuucc

SEQ ID NO: 15545 - RNA, 18 nt, artificial
  Chemically synthesized
guggucacagcaguggcc

SEQ ID NO: 15546 - RNA, 18 nt, artificial
  Chemically synthesized
caguugccggaucaucuc

SEQ ID NO: 15547 - RNA, 18 nt, artificial
  Chemically synthesized
uguccgugggacacugcu

SEQ ID NO: 15548 - RNA, 18 nt, artificial
  Chemically synthesized
gucgcauugucugccagc

SEQ ID NO: 15549 - RNA, 18 nt, artificial
  Chemically synthesized
aguuugguuucaaugagu

SEQ ID NO: 15550 - RNA, 18 nt, artificial
  Chemically synthesized
cuaugcuucaccauuucc

SEQ ID NO: 15551 - RNA, 18 nt, artificial
  Chemically synthesized
agcugggaggugugaaag

SEQ ID NO: 15552 - RNA, 18 nt, artificial
  Chemically synthesized
aaaagcagcccaagcugc

SEQ ID NO: 15553 - RNA, 18 nt, artificial
  Chemically synthesized
uugcucugcagguaauca

SEQ ID NO: 15554 - RNA, 18 nt, artificial
  Chemically synthesized
uuccucucucugugcuuc

SEQ ID NO: 15555 - RNA, 18 nt, artificial
  Chemically synthesized
aagaugcagaugagaggu

SEQ ID NO: 15556 - RNA, 18 nt, artificial
  Chemically synthesized
agagcuaugcuucaccau

SEQ ID NO: 15557 - RNA, 18 nt, artificial
  Chemically synthesized
ggaagaauggcaaauauc

SEQ ID NO: 15558 - RNA, 18 nt, artificial
  Chemically synthesized
cucugggaaggagagagg

SEQ ID NO: 15559 - RNA, 18 nt, artificial
  Chemically synthesized
agcauguaguccagcaac

SEQ ID NO: 15560 - RNA, 18 nt, artificial
  Chemically synthesized
ugugcagaggcacugaag

SEQ ID NO: 15561 - RNA, 18 nt, artificial
  Chemically synthesized
cuucugaugggcaccugg

SEQ ID NO: 15562 - RNA, 18 nt, artificial
  Chemically synthesized
cagggcagaaguacaugg

SEQ ID NO: 15563 - RNA, 18 nt, artificial
  Chemically synthesized
aguugccggaucuccaag

SEQ ID NO: 15564 - RNA, 18 nt, artificial
  Chemically synthesized
ugaaaagcagcccaagcu

SEQ ID NO: 15565 - RNA, 18 nt, artificial
  Chemically synthesized
uccagcaaguggacaugc

SEQ ID NO: 15566 - RNA, 18 nt, artificial
  Chemically synthesized
ucacugcugaagguuggg

SEQ ID NO: 15567 - RNA, 18 nt, artificial
  Chemically synthesized
ggauucaaacacagcuac

SEQ ID NO: 15568 - RNA, 18 nt, artificial
  Chemically synthesized
ucugccagcgcuuccucu

SEQ ID NO: 15569 - RNA, 18 nt, artificial
  Chemically synthesized
agcacagauuccuccuac

SEQ ID NO: 15570 - RNA, 18 nt, artificial
  Chemically synthesized
cagacagugaugaaccuc

SEQ ID NO: 15571 - RNA, 18 nt, artificial
  Chemically synthesized
cagguggaaaugaaaagc

SEQ ID NO: 15572 - RNA, 18 nt, artificial
  Chemically synthesized
agugaugaaccucaggau

SEQ ID NO: 15573 - RNA, 18 nt, artificial
  Chemically synthesized
augaaaagcagcccaagc

SEQ ID NO: 15574 - RNA, 18 nt, artificial
  Chemically synthesized
cucagagcugagcuggcu

SEQ ID NO: 15575 - RNA, 18 nt, artificial
  Chemically synthesized
auuuuuguucagggacau

SEQ ID NO: 15576 - RNA, 18 nt, artificial
  Chemically synthesized
ggucagacacacacaacu

SEQ ID NO: 15577 - RNA, 18 nt, artificial
  Chemically synthesized
aacucaggaugcaagaua

SEQ ID NO: 15578 - RNA, 18 nt, artificial
  Chemically synthesized
augugauguccagcugcu

SEQ ID NO: 15579 - RNA, 18 nt, artificial
  Chemically synthesized
auggcuuuaaaaugccca

SEQ ID NO: 15580 - RNA, 18 nt, artificial
  Chemically synthesized
uuggauuuaggguccuag

SEQ ID NO: 15581 - RNA, 18 nt, artificial
  Chemically synthesized
gaagggaggauguggagg

SEQ ID NO: 15582 - RNA, 18 nt, artificial
  Chemically synthesized
auccagcaaguggacaug

SEQ ID NO: 15583 - RNA, 18 nt, artificial
  Chemically synthesized
acagauuccuccuacaac

SEQ ID NO: 15584 - RNA, 18 nt, artificial
  Chemically synthesized
guugccggaucuccaagu

SEQ ID NO: 15585 - RNA, 18 nt, artificial
  Chemically synthesized
ugucguggucacagcagu

SEQ ID NO: 15586 - RNA, 18 nt, artificial
  Chemically synthesized
ugccaggcguccagcagc

SEQ ID NO: 15587 - RNA, 18 nt, artificial
  Chemically synthesized
uaagaccauggcaccuuc

SEQ ID NO: 15588 - RNA, 18 nt, artificial
  Chemically synthesized
ugccugugugugugagag

SEQ ID NO: 15589 - RNA, 18 nt, artificial
  Chemically synthesized
caaguggacaugccacuc

SEQ ID NO: 15590 - RNA, 18 nt, artificial
  Chemically synthesized
uggaaugggcggugugca

SEQ ID NO: 15591 - RNA, 18 nt, artificial
  Chemically synthesized
gugaugaaccucaggaug

SEQ ID NO: 15592 - RNA, 18 nt, artificial
  Chemically synthesized
guuggugggaaagcucuc

SEQ ID NO: 15593 - RNA, 18 nt, artificial
  Chemically synthesized
aggaggaaguggaauggg

SEQ ID NO: 15594 - RNA, 18 nt, artificial
  Chemically synthesized
cucuuuucgaugagcuca

SEQ ID NO: 15595 - RNA, 18 nt, artificial
  Chemically synthesized
cuccucaaugcugggucc

SEQ ID NO: 15596 - RNA, 18 nt, artificial
  Chemically synthesized
gaucuccaaguacucaaa

SEQ ID NO: 15597 - RNA, 18 nt, artificial
  Chemically synthesized
gucgggucgcauugucug

SEQ ID NO: 15598 - RNA, 18 nt, artificial
  Chemically synthesized
ucccacuccucaagugag

SEQ ID NO: 15599 - RNA, 18 nt, artificial
  Chemically synthesized
ucuuccucucucugugcu

SEQ ID NO: 15600 - RNA, 18 nt, artificial
  Chemically synthesized
uccgugggacacugcugu

SEQ ID NO: 15601 - RNA, 18 nt, artificial
  Chemically synthesized
cuaaaugccucaacaaga

SEQ ID NO: 15602 - RNA, 18 nt, artificial
  Chemically synthesized
gacuugucacugcugaag

SEQ ID NO: 15603 - RNA, 18 nt, artificial
  Chemically synthesized
ugccaggcaggacaucgc

SEQ ID NO: 15604 - RNA, 18 nt, artificial
  Chemically synthesized
gggacacaagagaaaagg

SEQ ID NO: 15605 - RNA, 18 nt, artificial
  Chemically synthesized
cugauaauccagcaagug

SEQ ID NO: 15606 - RNA, 18 nt, artificial
  Chemically synthesized
acaaccaccaccauccgg

SEQ ID NO: 15607 - RNA, 18 nt, artificial
  Chemically synthesized
cuccugcagccauggcgg

SEQ ID NO: 15608 - RNA, 18 nt, artificial
  Chemically synthesized
cuuuuggcaauccuccuc

SEQ ID NO: 15609 - RNA, 18 nt, artificial
  Chemically synthesized
cacugcugucuacagcgg

SEQ ID NO: 15610 - RNA, 18 nt, artificial
  Chemically synthesized
gaagaugccucuugagau

SEQ ID NO: 15611 - RNA, 18 nt, artificial
  Chemically synthesized
agaggccaggaucccuuc

SEQ ID NO: 15612 - RNA, 18 nt, artificial
  Chemically synthesized
gcuuuuauauggucgcug

SEQ ID NO: 15613 - RNA, 18 nt, artificial
  Chemically synthesized
uggucgcuguuuguaaac

SEQ ID NO: 15614 - RNA, 18 nt, artificial
  Chemically synthesized
guacauggacaggcagac

SEQ ID NO: 15615 - RNA, 18 nt, artificial
  Chemically synthesized
aaacguguguaugcuggu

SEQ ID NO: 15616 - RNA, 18 nt, artificial
  Chemically synthesized
cgugggacacugcugucu

SEQ ID NO: 15617 - RNA, 18 nt, artificial
  Chemically synthesized
ucugcagguggcccaggg

SEQ ID NO: 15618 - RNA, 18 nt, artificial
  Chemically synthesized
ggacaugguuaggcuccc

SEQ ID NO: 15619 - RNA, 18 nt, artificial
  Chemically synthesized
caaucaagguacaaaguu

SEQ ID NO: 15620 - RNA, 18 nt, artificial
  Chemically synthesized
aacacagcuacucucugu

SEQ ID NO: 15621 - RNA, 18 nt, artificial
  Chemically synthesized
gcagaaguacauggacag

SEQ ID NO: 15622 - RNA, 18 nt, artificial
  Chemically synthesized
aagaugccucuugagaug

SEQ ID NO: 15623 - RNA, 18 nt, artificial
  Chemically synthesized
augagagguggacccauu

SEQ ID NO: 15624 - RNA, 18 nt, artificial
  Chemically synthesized
cuggcugaaaguggagca

SEQ ID NO: 15625 - RNA, 18 nt, artificial
  Chemically synthesized
acauuccuugcucugcag

SEQ ID NO: 15626 - RNA, 18 nt, artificial
  Chemically synthesized
cagugaugaaccucagga

SEQ ID NO: 15627 - RNA, 18 nt, artificial
  Chemically synthesized
cuguaccuagaaaaacgu

SEQ ID NO: 15628 - RNA, 18 nt, artificial
  Chemically synthesized
cugcugcagacgugucug

SEQ ID NO: 15629 - RNA, 18 nt, artificial
  Chemically synthesized
augaaccucaggaugcug

SEQ ID NO: 15630 - RNA, 18 nt, artificial
  Chemically synthesized
agccagcucucccgcagc

SEQ ID NO: 15631 - RNA, 18 nt, artificial
  Chemically synthesized
uccaucuccuccgccagc

SEQ ID NO: 15632 - RNA, 18 nt, artificial
  Chemically synthesized
cagccagcucucccgcag

SEQ ID NO: 15633 - RNA, 18 nt, artificial
  Chemically synthesized
cagauacacacacaccca

SEQ ID NO: 15634 - RNA, 18 nt, artificial
  Chemically synthesized
aggagacccagagcuaug

SEQ ID NO: 15635 - RNA, 18 nt, artificial
  Chemically synthesized
guggaaaugaaaagcagc

SEQ ID NO: 15636 - RNA, 18 nt, artificial
  Chemically synthesized
agcaaguggacaugccac

SEQ ID NO: 15637 - RNA, 18 nt, artificial
  Chemically synthesized
gccucagaacagucuuca

SEQ ID NO: 15638 - RNA, 18 nt, artificial
  Chemically synthesized
ugauguccagcugcugca

SEQ ID NO: 15639 - RNA, 18 nt, artificial
  Chemically synthesized
gacaugaaaugugauguc

SEQ ID NO: 15640 - RNA, 18 nt, artificial
  Chemically synthesized
gcugguccuguucuauag

SEQ ID NO: 15641 - RNA, 18 nt, artificial
  Chemically synthesized
cucaaaguccaucuccuc

SEQ ID NO: 15642 - RNA, 18 nt, artificial
  Chemically synthesized
auauaggaagaauggcaa

SEQ ID NO: 15643 - RNA, 18 nt, artificial
  Chemically synthesized
guuugucuguuccaguug

SEQ ID NO: 15644 - RNA, 18 nt, artificial
  Chemically synthesized
acaacuucagucgauagu

SEQ ID NO: 15645 - RNA, 18 nt, artificial
  Chemically synthesized
aaagcagcccaagcugcu

SEQ ID NO: 15646 - RNA, 18 nt, artificial
  Chemically synthesized
ccacucacagccacuggu

SEQ ID NO: 15647 - RNA, 18 nt, artificial
  Chemically synthesized
agugaggaaacugagggu

SEQ ID NO: 15648 - RNA, 18 nt, artificial
  Chemically synthesized
ugcucaggcgagucucuu

SEQ ID NO: 15649 - RNA, 18 nt, artificial
  Chemically synthesized
accagacacaggugccag

SEQ ID NO: 15650 - RNA, 18 nt, artificial
  Chemically synthesized
gcugcugcagacgugucu

SEQ ID NO: 15651 - RNA, 18 nt, artificial
  Chemically synthesized
ccgccagcucugcugucc

SEQ ID NO: 15652 - RNA, 18 nt, artificial
  Chemically synthesized
acagguggaaaugaaaag

SEQ ID NO: 15653 - RNA, 18 nt, artificial
  Chemically synthesized
gcaucaguaggcaucacu

SEQ ID NO: 15654 - RNA, 18 nt, artificial
  Chemically synthesized
cagcuaaaugccucaaca

SEQ ID NO: 15655 - RNA, 18 nt, artificial
  Chemically synthesized
uuuucgaugagcucacua

SEQ ID NO: 15656 - RNA, 18 nt, artificial
  Chemically synthesized
gugucugugaaguuggca

SEQ ID NO: 15657 - RNA, 18 nt, artificial
  Chemically synthesized
gggcauccauucccuccc

SEQ ID NO: 15658 - RNA, 18 nt, artificial
  Chemically synthesized
gagacaaccaccaccauc

SEQ ID NO: 15659 - RNA, 18 nt, artificial
  Chemically synthesized
aguuggugggaaagcucu

SEQ ID NO: 15660 - RNA, 18 nt, artificial
  Chemically synthesized
gugcauggcagcuaaaug

SEQ ID NO: 15661 - RNA, 18 nt, artificial
  Chemically synthesized
aaggcucccugcucacau

SEQ ID NO: 15662 - RNA, 18 nt, artificial
  Chemically synthesized
ucagucgcuucugauggg

SEQ ID NO: 15663 - RNA, 18 nt, artificial
  Chemically synthesized
gcaucacuguggaagaag

SEQ ID NO: 15664 - RNA, 18 nt, artificial
  Chemically synthesized
acaaacuggaugucgcug

SEQ ID NO: 15665 - RNA, 18 nt, artificial
  Chemically synthesized
gcugggccaaacugcuuc

SEQ ID NO: 15666 - RNA, 18 nt, artificial
  Chemically synthesized
aagauccuaagaaaaggu

SEQ ID NO: 15667 - RNA, 18 nt, artificial
  Chemically synthesized
agaggcgccagggcgucc

SEQ ID NO: 15668 - RNA, 18 nt, artificial
  Chemically synthesized
gauucaaacacagcuacu

SEQ ID NO: 15669 - RNA, 18 nt, artificial
  Chemically synthesized
gauauacuuuuggcaauc

SEQ ID NO: 15670 - RNA, 18 nt, artificial
  Chemically synthesized
ugugugugugagaguaca

SEQ ID NO: 15671 - RNA, 18 nt, artificial
  Chemically synthesized
caugaaaugugaugucca

SEQ ID NO: 15672 - RNA, 18 nt, artificial
  Chemically synthesized
ugggaaagcucucugcag

SEQ ID NO: 15673 - RNA, 18 nt, artificial
  Chemically synthesized
cucaaugcugggucccag

SEQ ID NO: 15674 - RNA, 18 nt, artificial
  Chemically synthesized
caucuccuccgccagcgc

SEQ ID NO: 15675 - RNA, 18 nt, artificial
  Chemically synthesized
ugcuggugccugugugug

SEQ ID NO: 15676 - RNA, 18 nt, artificial
  Chemically synthesized
ccaccaccauccggcggc

SEQ ID NO: 15677 - RNA, 18 nt, artificial
  Chemically synthesized
augcaggacaugaaaugu

SEQ ID NO: 15678 - RNA, 18 nt, artificial
  Chemically synthesized
ugaugggcaccuggagag

SEQ ID NO: 15679 - RNA, 18 nt, artificial
  Chemically synthesized
cgugucugugaaguuggc

SEQ ID NO: 15680 - RNA, 18 nt, artificial
  Chemically synthesized
cagcuugguaagcagcuc

SEQ ID NO: 15681 - RNA, 18 nt, artificial
  Chemically synthesized
gggucaucaaguguggug

SEQ ID NO: 15682 - RNA, 18 nt, artificial
  Chemically synthesized
gaucagucgcuucugaug

SEQ ID NO: 15683 - RNA, 18 nt, artificial
  Chemically synthesized
gucuguaugugcccaugu

SEQ ID NO: 15684 - RNA, 18 nt, artificial
  Chemically synthesized
acaggcagacagauacac

SEQ ID NO: 15685 - RNA, 18 nt, artificial
  Chemically synthesized
cacaaacuggaugucgcu

SEQ ID NO: 15686 - RNA, 18 nt, artificial
  Chemically synthesized
ugcuucaccauuuccuac

SEQ ID NO: 15687 - RNA, 18 nt, artificial
  Chemically synthesized
uaauccagcaaguggaca

SEQ ID NO: 15688 - RNA, 18 nt, artificial
  Chemically synthesized
ugcagaugagagguggac

SEQ ID NO: 15689 - RNA, 18 nt, artificial
  Chemically synthesized
ugggacacugcugucuac

SEQ ID NO: 15690 - RNA, 18 nt, artificial
  Chemically synthesized
guccuuuccagaguuugg

SEQ ID NO: 15691 - RNA, 18 nt, artificial
  Chemically synthesized
caagaucaugcagagagg

SEQ ID NO: 15692 - RNA, 18 nt, artificial
  Chemically synthesized
agaggcugagugcaaauu

SEQ ID NO: 15693 - RNA, 18 nt, artificial
  Chemically synthesized
gguccgcuugugucucca

SEQ ID NO: 15694 - RNA, 18 nt, artificial
  Chemically synthesized
ugaauaugccagaggcca

SEQ ID NO: 15695 - RNA, 18 nt, artificial
  Chemically synthesized
agguggaaaugaaaagca

SEQ ID NO: 15696 - RNA, 18 nt, artificial
  Chemically synthesized
aguggaaugggcggugug

SEQ ID NO: 15697 - RNA, 18 nt, artificial
  Chemically synthesized
ugcccaauuuuuguucag

SEQ ID NO: 15698 - RNA, 18 nt, artificial
  Chemically synthesized
guccaucuccuccgccag

SEQ ID NO: 15699 - RNA, 18 nt, artificial
  Chemically synthesized
cacagcuacucucuguuc

SEQ ID NO: 15700 - RNA, 18 nt, artificial
  Chemically synthesized
ccaccuguaaaggcuucu

SEQ ID NO: 15701 - RNA, 18 nt, artificial
  Chemically synthesized
gcuuuucucagauaucuu

SEQ ID NO: 15702 - RNA, 18 nt, artificial
  Chemically synthesized
agccuggcugaaagugga

SEQ ID NO: 15703 - RNA, 18 nt, artificial
  Chemically synthesized
uccucaaugcuggguccc

SEQ ID NO: 15704 - RNA, 18 nt, artificial
  Chemically synthesized
uuggcaucuccaggaauu

SEQ ID NO: 15705 - RNA, 18 nt, artificial
  Chemically synthesized
uccuagggucuguccugg

SEQ ID NO: 15706 - RNA, 18 nt, artificial
  Chemically synthesized
acagcugugucugcaguu

SEQ ID NO: 15707 - RNA, 18 nt, artificial
  Chemically synthesized
cccaggagacccagagcu

SEQ ID NO: 15708 - RNA, 18 nt, artificial
  Chemically synthesized
gaaguggaaugggcggug

SEQ ID NO: 15709 - RNA, 18 nt, artificial
  Chemically synthesized
cugcugucuacagcggcc

SEQ ID NO: 15710 - RNA, 18 nt, artificial
  Chemically synthesized
caccucuacccuugaggu

SEQ ID NO: 15711 - RNA, 18 nt, artificial
  Chemically synthesized
ugcccgccagcucugcug

SEQ ID NO: 15712 - RNA, 18 nt, artificial
  Chemically synthesized
ccaccuagcuguuccugg

SEQ ID NO: 15713 - RNA, 18 nt, artificial
  Chemically synthesized
agguaaguagagcacaga

SEQ ID NO: 15714 - RNA, 18 nt, artificial
  Chemically synthesized
aggcaucgaaacgcucag

SEQ ID NO: 15715 - RNA, 18 nt, artificial
  Chemically synthesized
gccacugguuccaugcag

SEQ ID NO: 15716 - RNA, 18 nt, artificial
  Chemically synthesized
agagcugagcuggcucug

SEQ ID NO: 15717 - RNA, 18 nt, artificial
  Chemically synthesized
ugccagaggccaggaucc

SEQ ID NO: 15718 - RNA, 18 nt, artificial
  Chemically synthesized
caaguacucaaaguccau

SEQ ID NO: 15719 - RNA, 18 nt, artificial
  Chemically synthesized
ggucgggucgcauugucu

SEQ ID NO: 15720 - RNA, 18 nt, artificial
  Chemically synthesized
ccuccugcagccauggcg

SEQ ID NO: 15721 - RNA, 18 nt, artificial
  Chemically synthesized
cgcuugugucuccaguug

SEQ ID NO: 15722 - RNA, 18 nt, artificial
  Chemically synthesized
ucaggaugcaagauauau

SEQ ID NO: 15723 - RNA, 18 nt, artificial
  Chemically synthesized
uagucgcagacagugaug

SEQ ID NO: 15724 - RNA, 18 nt, artificial
  Chemically synthesized
uggagcugagagcaugac

SEQ ID NO: 15725 - RNA, 18 nt, artificial
  Chemically synthesized
acuuucccaccuagcugu

SEQ ID NO: 15726 - RNA, 18 nt, artificial
  Chemically synthesized
acagugaugaaccucagg

SEQ ID NO: 15727 - RNA, 18 nt, artificial
  Chemically synthesized
gcagcucgagcagucggc

SEQ ID NO: 15728 - RNA, 18 nt, artificial
  Chemically synthesized
gacagugaugaaccucag

SEQ ID NO: 15729 - RNA, 18 nt, artificial
  Chemically synthesized
cacguucaagaacagaga

SEQ ID NO: 15730 - RNA, 18 nt, artificial
  Chemically synthesized
cagacacaggugccaggc

SEQ ID NO: 15731 - RNA, 18 nt, artificial
  Chemically synthesized
gcucucccgcagccaagc

SEQ ID NO: 15732 - RNA, 18 nt, artificial
  Chemically synthesized
cuggcugauaauccagca

SEQ ID NO: 15733 - RNA, 18 nt, artificial
  Chemically synthesized
gagagggagagaacagcu

SEQ ID NO: 15734 - RNA, 18 nt, artificial
  Chemically synthesized
gugcaaauuuggucugga

SEQ ID NO: 15735 - RNA, 18 nt, artificial
  Chemically synthesized
ccaagauuuggugcaggg

SEQ ID NO: 15736 - RNA, 18 nt, artificial
  Chemically synthesized
ucuacagcggccaccugu

SEQ ID NO: 15737 - RNA, 18 nt, artificial
  Chemically synthesized
ggacaugaaaugugaugu

SEQ ID NO: 15738 - RNA, 18 nt, artificial
  Chemically synthesized
ggaauagaugagugccca

SEQ ID NO: 15739 - RNA, 18 nt, artificial
  Chemically synthesized
gaaaaggaauagaugagu

SEQ ID NO: 15740 - RNA, 18 nt, artificial
  Chemically synthesized
agaugagagguggaccca

SEQ ID NO: 15741 - RNA, 18 nt, artificial
  Chemically synthesized
caggaggcuuuuauaugg

SEQ ID NO: 15742 - RNA, 18 nt, artificial
  Chemically synthesized
agcugagagcaugaccac

SEQ ID NO: 15743 - RNA, 18 nt, artificial
  Chemically synthesized
gcaaauaucggcuuuucu

SEQ ID NO: 15744 - RNA, 18 nt, artificial
  Chemically synthesized
uuuccuacagggauucaa

SEQ ID NO: 15745 - RNA, 18 nt, artificial
  Chemically synthesized
ggcaauagcagaugaagg

SEQ ID NO: 15746 - RNA, 18 nt, artificial
  Chemically synthesized
agcucugcuguccguggg

SEQ ID NO: 15747 - RNA, 18 nt, artificial
  Chemically synthesized
uuggcaaggcgaguccag

SEQ ID NO: 15748 - RNA, 18 nt, artificial
  Chemically synthesized
uaggaagaauggcaaaua

SEQ ID NO: 15749 - RNA, 18 nt, artificial
  Chemically synthesized
uauaaauugcucugggaa

SEQ ID NO: 15750 - RNA, 18 nt, artificial
  Chemically synthesized
aaggcaucgaaacgcuca

SEQ ID NO: 15751 - RNA, 18 nt, artificial
  Chemically synthesized
gcacugaagcaucaguag

SEQ ID NO: 15752 - RNA, 18 nt, artificial
  Chemically synthesized
gguauaaauacugguaca

SEQ ID NO: 15753 - RNA, 18 nt, artificial
  Chemically synthesized
augcguacaaaacaugua

SEQ ID NO: 15754 - RNA, 18 nt, artificial
  Chemically synthesized
gcuucucagccuccuccu

SEQ ID NO: 15755 - RNA, 18 nt, artificial
  Chemically synthesized
gucacauuccuugcucug

SEQ ID NO: 15756 - RNA, 18 nt, artificial
  Chemically synthesized
cauuccuugcucugcagg

SEQ ID NO: 15757 - RNA, 18 nt, artificial
  Chemically synthesized
gauccuaagaaaagguac

SEQ ID NO: 15758 - RNA, 18 nt, artificial
  Chemically synthesized
cagggccucagaacaguc

SEQ ID NO: 15759 - RNA, 18 nt, artificial
  Chemically synthesized
cacagacaccuaagacca

SEQ ID NO: 15760 - RNA, 18 nt, artificial
  Chemically synthesized
ucacagccacugguucca

SEQ ID NO: 15761 - RNA, 18 nt, artificial
  Chemically synthesized
cauccauucccucccaag

SEQ ID NO: 15762 - RNA, 18 nt, artificial
  Chemically synthesized
augugugaauggcucaga

SEQ ID NO: 15763 - RNA, 18 nt, artificial
  Chemically synthesized
accuaagaccauggcacc

SEQ ID NO: 15764 - RNA, 18 nt, artificial
  Chemically synthesized
agcagucggccuacagag

SEQ ID NO: 15765 - RNA, 18 nt, artificial
  Chemically synthesized
gugugaaagaugcagaug

SEQ ID NO: 15766 - RNA, 18 nt, artificial
  Chemically synthesized
uguaugcuggugccugug

SEQ ID NO: 15767 - RNA, 18 nt, artificial
  Chemically synthesized
gacaucgcggucagacac

SEQ ID NO: 15768 - RNA, 18 nt, artificial
  Chemically synthesized
uaguguccuggcugauaa

SEQ ID NO: 15769 - RNA, 18 nt, artificial
  Chemically synthesized
uucaagaacagagacagg

SEQ ID NO: 15770 - RNA, 18 nt, artificial
  Chemically synthesized
cugugugugugagaguac

SEQ ID NO: 15771 - RNA, 18 nt, artificial
  Chemically synthesized
agccauggcgggcggucc

SEQ ID NO: 15772 - RNA, 18 nt, artificial
  Chemically synthesized
caacuucagucgauaguu

SEQ ID NO: 15773 - RNA, 18 nt, artificial
  Chemically synthesized
ugccucaacaagaucaug

SEQ ID NO: 15774 - RNA, 18 nt, artificial
  Chemically synthesized
accaagauuuggugcagg

SEQ ID NO: 15775 - RNA, 18 nt, artificial
  Chemically synthesized
gaggaaggcucccugcuc

SEQ ID NO: 15776 - RNA, 18 nt, artificial
  Chemically synthesized
caucgcggucagacacac

SEQ ID NO: 15777 - RNA, 18 nt, artificial
  Chemically synthesized
gagcugagcuggcucugc

SEQ ID NO: 15778 - RNA, 18 nt, artificial
  Chemically synthesized
aaguggagcaaagauaug

SEQ ID NO: 15779 - RNA, 18 nt, artificial
  Chemically synthesized
aggaaacugagggugaag

SEQ ID NO: 15780 - RNA, 18 nt, artificial
  Chemically synthesized
guucauuguugugugagu

SEQ ID NO: 15781 - RNA, 18 nt, artificial
  Chemically synthesized
aguacaugucuguacaua

SEQ ID NO: 15782 - RNA, 18 nt, artificial
  Chemically synthesized
gaggauguggaggagacc

SEQ ID NO: 15783 - RNA, 18 nt, artificial
  Chemically synthesized
ugcugcuucaagauauac

SEQ ID NO: 15784 - RNA, 18 nt, artificial
  Chemically synthesized
cugggucccagcuccagc

SEQ ID NO: 15785 - RNA, 18 nt, artificial
  Chemically synthesized
uugguguagucgcagaca

SEQ ID NO: 15786 - RNA, 18 nt, artificial
  Chemically synthesized
cugugucugcaguucauu

SEQ ID NO: 15787 - RNA, 18 nt, artificial
  Chemically synthesized
ggcacugaagcaucagua

SEQ ID NO: 15788 - RNA, 18 nt, artificial
  Chemically synthesized
uggcuuuaaaaugcccag

SEQ ID NO: 15789 - RNA, 18 nt, artificial
  Chemically synthesized
caccuagcuguuccuggg

SEQ ID NO: 15790 - RNA, 18 nt, artificial
  Chemically synthesized
uuucccaccuagcuguuc

SEQ ID NO: 15791 - RNA, 18 nt, artificial
  Chemically synthesized
agguacaaaguugguggg

SEQ ID NO: 15792 - RNA, 18 nt, artificial
  Chemically synthesized
gucucagcugguccuguu

SEQ ID NO: 15793 - RNA, 18 nt, artificial
  Chemically synthesized
uagcagaugaaggcaucg

SEQ ID NO: 15794 - RNA, 18 nt, artificial
  Chemically synthesized
gccagcucucccgcagcc

SEQ ID NO: 15795 - RNA, 18 nt, artificial
  Chemically synthesized
cucgcauguugagagcag

SEQ ID NO: 15796 - RNA, 18 nt, artificial
  Chemically synthesized
cuugaugaauaugccaga

SEQ ID NO: 15797 - RNA, 18 nt, artificial
  Chemically synthesized
uuauaaacucaggaugca

SEQ ID NO: 15798 - RNA, 18 nt, artificial
  Chemically synthesized
aggaauugagagguaagu

SEQ ID NO: 15799 - RNA, 18 nt, artificial
  Chemically synthesized
cuguggaagaagcugccc

SEQ ID NO: 15800 - RNA, 18 nt, artificial
  Chemically synthesized
ugagagcaugaccacagg

SEQ ID NO: 15801 - RNA, 18 nt, artificial
  Chemically synthesized
acucgcauguugagagca

SEQ ID NO: 15802 - RNA, 18 nt, artificial
  Chemically synthesized
ucuguuccaguugccgga

SEQ ID NO: 15803 - RNA, 18 nt, artificial
  Chemically synthesized
ggacacugcugucuacag

SEQ ID NO: 15804 - RNA, 18 nt, artificial
  Chemically synthesized
agucgauaguuugucugu

SEQ ID NO: 15805 - RNA, 18 nt, artificial
  Chemically synthesized
aucccacuccucaaguga

SEQ ID NO: 15806 - RNA, 18 nt, artificial
  Chemically synthesized
gacuuucccaccuagcug

SEQ ID NO: 15807 - RNA, 18 nt, artificial
  Chemically synthesized
guggagcaaagauaugca

SEQ ID NO: 15808 - RNA, 18 nt, artificial
  Chemically synthesized
gaaacugagggugaagau

SEQ ID NO: 15809 - RNA, 18 nt, artificial
  Chemically synthesized
guguccuggcugauaauc

SEQ ID NO: 15810 - RNA, 18 nt, artificial
  Chemically synthesized
gcauugucugccagcgcu

SEQ ID NO: 15811 - RNA, 18 nt, artificial
  Chemically synthesized
caucuccaggaauugaga

SEQ ID NO: 15812 - RNA, 18 nt, artificial
  Chemically synthesized
gugccaggcaggacaucg

SEQ ID NO: 15813 - RNA, 18 nt, artificial
  Chemically synthesized
gaggcugagugcaaauuu

SEQ ID NO: 15814 - RNA, 18 nt, artificial
  Chemically synthesized
gcaaagauaugcauuuuc

SEQ ID NO: 15815 - RNA, 18 nt, artificial
  Chemically synthesized
acaagagaaaaggaauag

SEQ ID NO: 15816 - RNA, 18 nt, artificial
  Chemically synthesized
acuccucaagugaggaaa

SEQ ID NO: 15817 - RNA, 18 nt, artificial
  Chemically synthesized
gaaaaacguguguaugcu

SEQ ID NO: 15818 - RNA, 18 nt, artificial
  Chemically synthesized
gcagcuaaaugccucaac

SEQ ID NO: 15819 - RNA, 18 nt, artificial
  Chemically synthesized
auccugacagguggaaau

SEQ ID NO: 15820 - RNA, 18 nt, artificial
  Chemically synthesized
gcucucugcagguggccc

SEQ ID NO: 15821 - RNA, 18 nt, artificial
  Chemically synthesized
ggaaauaaggcucaaggu

SEQ ID NO: 15822 - RNA, 18 nt, artificial
  Chemically synthesized
uuggguccuuuccagagu

SEQ ID NO: 15823 - RNA, 18 nt, artificial
  Chemically synthesized
gcuaaaugccucaacaag

SEQ ID NO: 15824 - RNA, 18 nt, artificial
  Chemically synthesized
uugccggaucuccaagua

SEQ ID NO: 15825 - RNA, 18 nt, artificial
  Chemically synthesized
cguucaagaacagagaca

SEQ ID NO: 15826 - RNA, 18 nt, artificial
  Chemically synthesized
cagacgugucugugaagu

SEQ ID NO: 15827 - RNA, 18 nt, artificial
  Chemically synthesized
aggcucccugcucacauc

SEQ ID NO: 15828 - RNA, 18 nt, artificial
  Chemically synthesized
ccuggcugaaaguggagc

SEQ ID NO: 15829 - RNA, 18 nt, artificial
  Chemically synthesized
augggcggugugcagagg

SEQ ID NO: 15830 - RNA, 18 nt, artificial
  Chemically synthesized
uccagcagcacgucgucg

SEQ ID NO: 15831 - RNA, 18 nt, artificial
  Chemically synthesized
agcugcucaggcgagucu

SEQ ID NO: 15832 - RNA, 18 nt, artificial
  Chemically synthesized
guguagucgcagacagug

SEQ ID NO: 15833 - RNA, 18 nt, artificial
  Chemically synthesized
cagagcuaugcuucacca

SEQ ID NO: 15834 - RNA, 18 nt, artificial
  Chemically synthesized
cugagcuggcucugcugg

SEQ ID NO: 15835 - RNA, 18 nt, artificial
  Chemically synthesized
ccuuggcaaggcgagucc

SEQ ID NO: 15836 - RNA, 18 nt, artificial
  Chemically synthesized
gcaaguggacaugccacu

SEQ ID NO: 15837 - RNA, 18 nt, artificial
  Chemically synthesized
aggaaguggaaugggcgg

SEQ ID NO: 15838 - RNA, 18 nt, artificial
  Chemically synthesized
ugagcuggcucugcuggu

SEQ ID NO: 15839 - RNA, 18 nt, artificial
  Chemically synthesized
cguguguaugcuggugcc

SEQ ID NO: 15840 - RNA, 18 nt, artificial
  Chemically synthesized
agugucguggucacagca

SEQ ID NO: 15841 - RNA, 18 nt, artificial
  Chemically synthesized
cggaucuccaaguacuca

SEQ ID NO: 15842 - RNA, 18 nt, artificial
  Chemically synthesized
ggagacccagagcuaugc

SEQ ID NO: 15843 - RNA, 18 nt, artificial
  Chemically synthesized
gagaagcgccgcccugcc

SEQ ID NO: 15844 - RNA, 18 nt, artificial
  Chemically synthesized
aguagggacacaagagaa

SEQ ID NO: 15845 - RNA, 18 nt, artificial
  Chemically synthesized
agguaaucaucagagaca

SEQ ID NO: 15846 - RNA, 18 nt, artificial
  Chemically synthesized
cucagugaugggacuuuc

SEQ ID NO: 15847 - RNA, 18 nt, artificial
  Chemically synthesized
gaugugugaauggcucag

SEQ ID NO: 15848 - RNA, 18 nt, artificial
  Chemically synthesized
agcucucugcagguggcc

SEQ ID NO: 15849 - RNA, 18 nt, artificial
  Chemically synthesized
ugggucccagcuccagca

SEQ ID NO: 15850 - RNA, 18 nt, artificial
  Chemically synthesized
uacaacgaaaggaggagg

SEQ ID NO: 15851 - RNA, 18 nt, artificial
  Chemically synthesized
cucugcagguaaucauca

SEQ ID NO: 15852 - RNA, 18 nt, artificial
  Chemically synthesized
cugcucaggcgagucucu

SEQ ID NO: 15853 - RNA, 18 nt, artificial
  Chemically synthesized
cacccagggccucagaac

SEQ ID NO: 15854 - RNA, 18 nt, artificial
  Chemically synthesized
cacucgcauguugagagc

SEQ ID NO: 15855 - RNA, 18 nt, artificial
  Chemically synthesized
aagcugggaggugugaaa

SEQ ID NO: 15856 - RNA, 18 nt, artificial
  Chemically synthesized
ugucuccaguugccggau

SEQ ID NO: 15857 - RNA, 18 nt, artificial
  Chemically synthesized
ugugauguccagcugcug

SEQ ID NO: 15858 - RNA, 18 nt, artificial
  Chemically synthesized
gagaaaaggaauagauga

SEQ ID NO: 15859 - RNA, 18 nt, artificial
  Chemically synthesized
aauggcaaauaucggcuu

SEQ ID NO: 15860 - RNA, 18 nt, artificial
  Chemically synthesized
augaccacaggcauccug

SEQ ID NO: 15861 - RNA, 18 nt, artificial
  Chemically synthesized
auuuaggguccuaggguc

SEQ ID NO: 15862 - RNA, 18 nt, artificial
  Chemically synthesized
caucccacuccucaagug

SEQ ID NO: 15863 - RNA, 18 nt, artificial
  Chemically synthesized
ugcccaugugcccacaag

SEQ ID NO: 15864 - RNA, 18 nt, artificial
  Chemically synthesized
ccgcccugcccuacaauc

SEQ ID NO: 15865 - RNA, 18 nt, artificial
  Chemically synthesized
acugagggugaagaugug

SEQ ID NO: 15866 - RNA, 18 nt, artificial
  Chemically synthesized
aucgcggucagacacaca

SEQ ID NO: 15867 - RNA, 18 nt, artificial
  Chemically synthesized
aggcauccugacaggugg

SEQ ID NO: 15868 - RNA, 18 nt, artificial
  Chemically synthesized
ugcucacaucauuacagu

SEQ ID NO: 15869 - RNA, 18 nt, artificial
  Chemically synthesized
cuugguaagcagcucgag

SEQ ID NO: 15870 - RNA, 18 nt, artificial
  Chemically synthesized
gauggcuuuaaaaugccc

SEQ ID NO: 15871 - RNA, 18 nt, artificial
  Chemically synthesized
cuguccgugggacacugc

SEQ ID NO: 15872 - RNA, 18 nt, artificial
  Chemically synthesized
uuccaugcaggacaugaa

SEQ ID NO: 15873 - RNA, 18 nt, artificial
  Chemically synthesized
cccagggaggaaggcucc

SEQ ID NO: 15874 - RNA, 18 nt, artificial
  Chemically synthesized
gagcuaugcuucaccauu

SEQ ID NO: 15875 - RNA, 18 nt, artificial
  Chemically synthesized
uauuccaggauauaggaa

SEQ ID NO: 15876 - RNA, 18 nt, artificial
  Chemically synthesized
aaugaaaagcagcccaag

SEQ ID NO: 15877 - RNA, 18 nt, artificial
  Chemically synthesized
cuugcucugcagguaauc

SEQ ID NO: 15878 - RNA, 18 nt, artificial
  Chemically synthesized
gagaacagcugugucugc

SEQ ID NO: 15879 - RNA, 18 nt, artificial
  Chemically synthesized
caauccuccucaaugcug

SEQ ID NO: 15880 - RNA, 18 nt, artificial
  Chemically synthesized
gaacagucuucagggcag

SEQ ID NO: 15881 - RNA, 18 nt, artificial
  Chemically synthesized
cagcucgagcagucggcc

SEQ ID NO: 15882 - RNA, 18 nt, artificial
  Chemically synthesized
gcagugucguggucacag

SEQ ID NO: 15883 - RNA, 18 nt, artificial
  Chemically synthesized
uguagucgcagacaguga

SEQ ID NO: 15884 - RNA, 18 nt, artificial
  Chemically synthesized
gccuuggcaaggcgaguc

SEQ ID NO: 15885 - RNA, 18 nt, artificial
  Chemically synthesized
ucgaggcgggugaugugg

SEQ ID NO: 15886 - RNA, 18 nt, artificial
  Chemically synthesized
cucuuucuccugcggcac

SEQ ID NO: 15887 - RNA, 18 nt, artificial
  Chemically synthesized
agcgcgguccagucggcc

SEQ ID NO: 15888 - RNA, 18 nt, artificial
  Chemically synthesized
augagcucacuagcaaua

SEQ ID NO: 15889 - RNA, 18 nt, artificial
  Chemically synthesized
cugcacaaacuggauguc

SEQ ID NO: 15890 - RNA, 18 nt, artificial
  Chemically synthesized
cuggugccugugugugug

SEQ ID NO: 15891 - RNA, 18 nt, artificial
  Chemically synthesized
caaaguuggugggaaagc

SEQ ID NO: 15892 - RNA, 18 nt, artificial
  Chemically synthesized
agcuaugcuucaccauuu

SEQ ID NO: 15893 - RNA, 18 nt, artificial
  Chemically synthesized
ucaucaaguguggugaug

SEQ ID NO: 15894 - RNA, 18 nt, artificial
  Chemically synthesized
auccuccucaaugcuggg

SEQ ID NO: 15895 - RNA, 18 nt, artificial
  Chemically synthesized
gcaggaggcuuuuauaug

SEQ ID NO: 15896 - RNA, 18 nt, artificial
  Chemically synthesized
ugguuaggcucccucagu

SEQ ID NO: 15897 - RNA, 18 nt, artificial
  Chemically synthesized
guggccagcauguagucc

SEQ ID NO: 15898 - RNA, 18 nt, artificial
  Chemically synthesized
gaugaaggcaucgaaacg

SEQ ID NO: 15899 - RNA, 18 nt, artificial
  Chemically synthesized
guuccaugcaggacauga

SEQ ID NO: 15900 - RNA, 18 nt, artificial
  Chemically synthesized
gagguggacccauuagga

SEQ ID NO: 15901 - RNA, 18 nt, artificial
  Chemically synthesized
agcucucuuccucucucu

SEQ ID NO: 15902 - RNA, 18 nt, artificial
  Chemically synthesized
gcuuuccgagaagcgccg

SEQ ID NO: 15903 - RNA, 18 nt, artificial
  Chemically synthesized
ucgucgcggcccagcuug

SEQ ID NO: 15904 - RNA, 18 nt, artificial
  Chemically synthesized
guccuagggucuguccug

SEQ ID NO: 15905 - RNA, 18 nt, artificial
  Chemically synthesized
acagcaguggccagcaug

SEQ ID NO: 15906 - RNA, 18 nt, artificial
  Chemically synthesized
cggccaccuguaaaggcu

SEQ ID NO: 15907 - RNA, 18 nt, artificial
  Chemically synthesized
cagguggagcugagagca

SEQ ID NO: 15908 - RNA, 18 nt, artificial
  Chemically synthesized
caugguuaggcucccuca

SEQ ID NO: 15909 - RNA, 18 nt, artificial
  Chemically synthesized
guggaaugggcggugugc

SEQ ID NO: 15910 - RNA, 18 nt, Artificial Sequence
  Chemically synthesized
ucugcuguccgugggaca

SEQ ID NO: 15911 - RNA, 18 nt, artificial
  Chemically synthesized
uuccagaccaaauuugca

SEQ ID NO: 15912 - RNA, 18 nt, artificial
  Chemically synthesized
cuggcgggcaucaccaca

SEQ ID NO: 15913 - RNA, 18 nt, artificial
  Chemically synthesized
gccgcgacgacgugcugc

SEQ ID NO: 15914 - RNA, 18 nt, artificial
  Chemically synthesized
uggccgcuguagacagca

SEQ ID NO: 15915 - RNA, 18 nt, artificial
  Chemically synthesized
uagacagcagugucccac

SEQ ID NO: 15916 - RNA, 18 nt, artificial
  Chemically synthesized
cucagccucucuccaggu

SEQ ID NO: 15917 - RNA, 18 nt, artificial
  Chemically synthesized
uggaacagacaaacuauc

SEQ ID NO: 15918 - RNA, 18 nt, artificial
  Chemically synthesized
caggaggaggcugagaag

SEQ ID NO: 15919 - RNA, 18 nt, artificial
  Chemically synthesized
gccuggcagggacgcccu

SEQ ID NO: 15920 - RNA, 18 nt, artificial
  Chemically synthesized
ggugccgccggauggugg

SEQ ID NO: 15921 - RNA, 18 nt, artificial
  Chemically synthesized
uggcugcucucaacaugc

SEQ ID NO: 15922 - RNA, 18 nt, artificial
  Chemically synthesized
aucagaagcgacugaucc

SEQ ID NO: 15923 - RNA, 18 nt, artificial
  Chemically synthesized
cggucuccuccacauccu

SEQ ID NO: 15924 - RNA, 18 nt, artificial
  Chemically synthesized
ccgcgacgacgugcugcu

SEQ ID NO: 15925 - RNA, 18 nt, artificial
  Chemically synthesized
guugugugugucugaccg

SEQ ID NO: 15926 - RNA, 18 nt, artificial
  Chemically synthesized
ccucucuccaggugccca

SEQ ID NO: 15927 - RNA, 18 nt, artificial
  Chemically synthesized
cugcuggacgccuggcag

SEQ ID NO: 15928 - RNA, 18 nt, artificial
  Chemically synthesized
gcucaucgaaaagaggug

SEQ ID NO: 15929 - RNA, 18 nt, artificial
  Chemically synthesized
acgacgugcugcuggagc

SEQ ID NO: 15930 - RNA, 18 nt, artificial
  Chemically synthesized
uucuugaacgugcggaca

SEQ ID NO: 15931 - RNA, 18 nt, artificial
  Chemically synthesized
ccggucuccuccacaucc

SEQ ID NO: 15932 - RNA, 18 nt, artificial
  Chemically synthesized
gugcaggagaugauccgg

SEQ ID NO: 15933 - RNA, 18 nt, artificial
  Chemically synthesized
cccacuggcaggcugcug

SEQ ID NO: 15934 - RNA, 18 nt, artificial
  Chemically synthesized
cgccggaugguggugguu

SEQ ID NO: 15935 - RNA, 18 nt, artificial
  Chemically synthesized
ugcccaucagaagcgacu

SEQ ID NO: 15936 - RNA, 18 nt, artificial
  Chemically synthesized
cuaucgacugaaguugug

SEQ ID NO: 15937 - RNA, 18 nt, artificial
  Chemically synthesized
ggcugcaggaggucccgg

SEQ ID NO: 15938 - RNA, 18 nt, artificial
  Chemically synthesized
guucuggacucgccuugc

SEQ ID NO: 15939 - RNA, 18 nt, artificial
  Chemically synthesized
gucuccuccacauccucc

SEQ ID NO: 15940 - RNA, 18 nt, artificial
  Chemically synthesized
ugguucuggacucgccuu

SEQ ID NO: 15941 - RNA, 18 nt, artificial
  Chemically synthesized
gccuugccaaggccuugu

SEQ ID NO: 15942 - RNA, 18 nt, artificial
  Chemically synthesized
uaucgacugaaguugugu

SEQ ID NO: 15943 - RNA, 18 nt, artificial
  Chemically synthesized
gcagcaggaggaggcuga

SEQ ID NO: 15944 - RNA, 18 nt, artificial
  Chemically synthesized
ugccugagcguuucgaug

SEQ ID NO: 15945 - RNA, 18 nt, artificial
  Chemically synthesized
cugccuggcaccuguguc

SEQ ID NO: 15946 - RNA, 18 nt, artificial
  Chemically synthesized
gacgacgugcugcuggag

SEQ ID NO: 15947 - RNA, 18 nt, artificial
  Chemically synthesized
cucucuccaggugcccau

SEQ ID NO: 15948 - RNA, 18 nt, artificial
  Chemically synthesized
uaccugcagagcaaggaa

SEQ ID NO: 15949 - RNA, 18 nt, artificial
  Chemically synthesized
uuugcacucagccucucu

SEQ ID NO: 15950 - RNA, 18 nt, artificial
  Chemically synthesized
ucuugguucuggacucgc

SEQ ID NO: 15951 - RNA, 18 nt, artificial
  Chemically synthesized
acugaaguuguguguguc

SEQ ID NO: 15952 - RNA, 18 nt, artificial
  Chemically synthesized
guccugccuggcaccugu

SEQ ID NO: 15953 - RNA, 18 nt, artificial
  Chemically synthesized
gggccgcgacgacgugcu

SEQ ID NO: 15954 - RNA, 18 nt, artificial
  Chemically synthesized
ccaaggccuugucccugc

SEQ ID NO: 15955 - RNA, 18 nt, artificial
  Chemically synthesized
uguccugccuggcaccug

SEQ ID NO: 15956 - RNA, 18 nt, artificial
  Chemically synthesized
uccaggugcccaucagaa

SEQ ID NO: 15957 - RNA, 18 nt, artificial
  Chemically synthesized
caaaucuugguucuggac

SEQ ID NO: 15958 - RNA, 18 nt, artificial
  Chemically synthesized
cuuuacagguggccgcug

SEQ ID NO: 15959 - RNA, 18 nt, artificial
  Chemically synthesized
gcugcuuaccaagcuggg

SEQ ID NO: 15960 - RNA, 18 nt, artificial
  Chemically synthesized
gaagcagcagcaggagga

SEQ ID NO: 15961 - RNA, 18 nt, artificial
  Chemically synthesized
aaguugugugugucugac

SEQ ID NO: 15962 - RNA, 18 nt, artificial
  Chemically synthesized
agugucccacggacagca

SEQ ID NO: 15963 - RNA, 18 nt, artificial
  Chemically synthesized
gauccggcaacuggaaca

SEQ ID NO: 15964 - RNA, 18 nt, artificial
  Chemically synthesized
cugcaccaaaucuugguu

SEQ ID NO: 15965 - RNA, 18 nt, artificial
  Chemically synthesized
cgacgugcugcuggagcu

SEQ ID NO: 15966 - RNA, 18 nt, artificial
  Chemically synthesized
cgcgacgacgugcugcug

SEQ ID NO: 15967 - RNA, 18 nt, artificial
  Chemically synthesized
aggccuugucccugcccu

SEQ ID NO: 15968 - RNA, 18 nt, artificial
  Chemically synthesized
augccugagcguuucgau

SEQ ID NO: 15969 - RNA, 18 nt, artificial
  Chemically synthesized
uccacauccucccuuccc

SEQ ID NO: 15970 - RNA, 18 nt, artificial
  Chemically synthesized
gcugggccgcgacgacgu

SEQ ID NO: 15971 - RNA, 18 nt, artificial
  Chemically synthesized
agcugcuuaccaagcugg

SEQ ID NO: 15972 - RNA, 18 nt, artificial
  Chemically synthesized
accaaauuugcacucagc

SEQ ID NO: 15973 - RNA, 18 nt, artificial
  Chemically synthesized
cucgccuugccaaggccu

SEQ ID NO: 15974 - RNA, 18 nt, artificial
  Chemically synthesized
aaacuaucgacugaaguu

SEQ ID NO: 15975 - RNA, 18 nt, artificial
  Chemically synthesized
cggaugguggugguuguc

SEQ ID NO: 15976 - RNA, 18 nt, artificial
  Chemically synthesized
guugucucugaugauuac

SEQ ID NO: 15977 - RNA, 18 nt, artificial
  Chemically synthesized
cacuggcaggcugcugga

SEQ ID NO: 15978 - RNA, 18 nt, artificial
  Chemically synthesized
agguggcggccgacugga

SEQ ID NO: 15979 - RNA, 18 nt, artificial
  Chemically synthesized
agcugggccgcgacgacg

SEQ ID NO: 15980 - RNA, 18 nt, artificial
  Chemically synthesized
ccugccuggcaccugugu

SEQ ID NO: 15981 - RNA, 18 nt, artificial
  Chemically synthesized
gugcccaucagaagcgac

SEQ ID NO: 15982 - RNA, 18 nt, artificial
  Chemically synthesized
cugcuuaccaagcugggc

SEQ ID NO: 15983 - RNA, 18 nt, artificial
  Chemically synthesized
cccggucuccuccacauc

SEQ ID NO: 15984 - RNA, 18 nt, artificial
  Chemically synthesized
caggcugcuggacgccug

SEQ ID NO: 15985 - RNA, 18 nt, artificial
  Chemically synthesized
aacagacaaacuaucgac

SEQ ID NO: 15986 - RNA, 18 nt, artificial
  Chemically synthesized
ggacgccuggcagggacg

SEQ ID NO: 15987 - RNA, 18 nt, artificial
  Chemically synthesized
uggacgccuggcagggac

SEQ ID NO: 15988 - RNA, 18 nt, artificial
  Chemically synthesized
uggcgggcaucaccacac

SEQ ID NO: 15989 - RNA, 18 nt, artificial
  Chemically synthesized
cuccacauccucccuucc

SEQ ID NO: 15990 - RNA, 18 nt, artificial
  Chemically synthesized
cuugaagcagcagcagga

SEQ ID NO: 15991 - RNA, 18 nt, artificial
  Chemically synthesized
ggcaggcugcuggacgcc

SEQ ID NO: 15992 - RNA, 18 nt, artificial
  Chemically synthesized
gguggcggccgacuggac

SEQ ID NO: 15993 - RNA, 18 nt, artificial
  Chemically synthesized
ugccuucaucugcuauug

SEQ ID NO: 15994 - RNA, 18 nt, artificial
  Chemically synthesized
gugcugcuggagcuggga

SEQ ID NO: 15995 - RNA, 18 nt, artificial
  Chemically synthesized
cuugguucuggacucgcc

SEQ ID NO: 15996 - RNA, 18 nt, artificial
  Chemically synthesized
cacagguggcggccgacu

SEQ ID NO: 15997 - RNA, 18 nt, artificial
  Chemically synthesized
ccuggcaccugugucugg

SEQ ID NO: 15998 - RNA, 18 nt, artificial
  Chemically synthesized
aaucuugguucuggacuc

SEQ ID NO: 15999 - RNA, 18 nt, artificial
  Chemically synthesized
auuugcacucagccucuc

SEQ ID NO: 16000 - RNA, 18 nt, artificial
  Chemically synthesized
ugcugcuggagcugggac

SEQ ID NO: 16001 - RNA, 18 nt, artificial
  Chemically synthesized
cucaacaugcgagugcgg

SEQ ID NO: 16002 - RNA, 18 nt, artificial
  Chemically synthesized
acgugcugcuggagcugg

SEQ ID NO: 16003 - RNA, 18 nt, artificial
  Chemically synthesized
ccgccggauggugguggu

SEQ ID NO: 16004 - RNA, 18 nt, artificial
  Chemically synthesized
aucuugaagcagcagcag

SEQ ID NO: 16005 - RNA, 18 nt, artificial
  Chemically synthesized
cgccuugccaaggccuug

SEQ ID NO: 16006 - RNA, 18 nt, artificial
  Chemically synthesized
cauggcugcaggaggucc

SEQ ID NO: 16007 - RNA, 18 nt, artificial
  Chemically synthesized
gcugcuggagcugggacc

SEQ ID NO: 16008 - RNA, 18 nt, artificial
  Chemically synthesized
caggugcccaucagaagc

SEQ ID NO: 16009 - RNA, 18 nt, artificial
  Chemically synthesized
ccuuuacagguggccgcu

SEQ ID NO: 16010 - RNA, 18 nt, artificial
  Chemically synthesized
cuggcagggacgcccugg

SEQ ID NO: 16011 - RNA, 18 nt, artificial
  Chemically synthesized
ugcggacacagguggcgg

SEQ ID NO: 16012 - RNA, 18 nt, artificial
  Chemically synthesized
ccugagcguuucgaugcc

SEQ ID NO: 16013 - RNA, 18 nt, artificial
  Chemically synthesized
ucucaacaugcgagugcg

SEQ ID NO: 16014 - RNA, 18 nt, artificial
  Chemically synthesized
uggcaccugugucugguc

SEQ ID NO: 16015 - RNA, 18 nt, artificial
  Chemically synthesized
ucgccuugccaaggccuu

SEQ ID NO: 16016 - RNA, 18 nt, artificial
  Chemically synthesized
acaaacuaucgacugaag

SEQ ID NO: 16017 - RNA, 18 nt, artificial
  Chemically synthesized
gacgugcugcuggagcug

SEQ ID NO: 16018 - RNA, 18 nt, artificial
  Chemically synthesized
ucaacaugcgagugcggc

SEQ ID NO: 16019 - RNA, 18 nt, artificial
  Chemically synthesized
gccuuuacagguggccgc

SEQ ID NO: 16020 - RNA, 18 nt, artificial
  Chemically synthesized
ugugcaggagaugauccg

SEQ ID NO: 16021 - RNA, 18 nt, artificial
  Chemically synthesized
ugaacgugcggacacagg

SEQ ID NO: 16022 - RNA, 18 nt, artificial
  Chemically synthesized
caacaugcgagugcggcg

SEQ ID NO: 16023 - RNA, 18 nt, artificial
  Chemically synthesized
ucgacugaaguugugugu

SEQ ID NO: 16024 - RNA, 18 nt, artificial
  Chemically synthesized
ggccgcgacgacgugcug

SEQ ID NO: 16025 - RNA, 18 nt, artificial
  Chemically synthesized
cauaugccugagcguuuc

SEQ ID NO: 16026 - RNA, 18 nt, artificial
  Chemically synthesized
aucgacugaaguugugug

SEQ ID NO: 16027 - RNA, 18 nt, artificial
  Chemically synthesized
gacacagguggcggccga

SEQ ID NO: 16028 - RNA, 18 nt, artificial
  Chemically synthesized
gaggugccgccggauggu

SEQ ID NO: 16029 - RNA, 18 nt, artificial
  Chemically synthesized
acgugcggacacaggugg

SEQ ID NO: 16030 - RNA, 18 nt, artificial
  Chemically synthesized
uuggagauccggcaacug

SEQ ID NO: 16031 - RNA, 18 nt, artificial
  Chemically synthesized
ugccuggcaccugugucu

SEQ ID NO: 16032 - RNA, 18 nt, artificial
  Chemically synthesized
gugcggacacagguggcg

SEQ ID NO: 16033 - RNA, 18 nt, artificial
  Chemically synthesized
uggagcugggacccagca

SEQ ID NO: 16034 - RNA, 18 nt, artificial
  Chemically synthesized
cuucaucugcuauugccc

SEQ ID NO: 16035 - RNA, 18 nt, artificial
  Chemically synthesized
uugcacucagccucucuc

SEQ ID NO: 16036 - RNA, 18 nt, artificial
  Chemically synthesized
agguucaucacugucugc

SEQ ID NO: 16037 - RNA, 18 nt, artificial
  Chemically synthesized
agggacgcccuggcgccu

SEQ ID NO: 16038 - RNA, 18 nt, artificial
  Chemically synthesized
ccuggcagggacgcccug

SEQ ID NO: 16039 - RNA, 18 nt, artificial
  Chemically synthesized
cuugccaaggccuugucc

SEQ ID NO: 16040 - RNA, 18 nt, artificial
  Chemically synthesized
ucagccucucuccaggug

SEQ ID NO: 16041 - RNA, 18 nt, artificial
  Chemically synthesized
aggugccgccggauggug

SEQ ID NO: 16042 - RNA, 18 nt, artificial
  Chemically synthesized
caugcgagugcggcgccg

SEQ ID NO: 16043 - RNA, 18 nt, artificial
  Chemically synthesized
cuccuccacauccucccu

SEQ ID NO: 16044 - RNA, 18 nt, artificial
  Chemically synthesized
uuugugcaggagaugauc

SEQ ID NO: 16045 - RNA, 18 nt, artificial
  Chemically synthesized
gaagccuuuacagguggc

SEQ ID NO: 16046 - RNA, 18 nt, artificial
  Chemically synthesized
cucaucgaaaagaggugc

SEQ ID NO: 16047 - RNA, 18 nt, artificial
  Chemically synthesized
uaugccugagcguuucga

SEQ ID NO: 16048 - RNA, 18 nt, artificial
  Chemically synthesized
uugguucuggacucgccu

SEQ ID NO: 16049 - RNA, 18 nt, artificial
  Chemically synthesized
uaccaagcugggccgcga

SEQ ID NO: 16050 - RNA, 18 nt, artificial
  Chemically synthesized
ugcuuaccaagcugggcc

SEQ ID NO: 16051 - RNA, 18 nt, artificial
  Chemically synthesized
guggcggccgacuggacc

SEQ ID NO: 16052 - RNA, 18 nt, artificial
  Chemically synthesized
ugccaaggccuugucccu

SEQ ID NO: 16053 - RNA, 18 nt, artificial
  Chemically synthesized
agcagcagcaggaggagg

SEQ ID NO: 16054 - RNA, 18 nt, artificial
  Chemically synthesized
gacgccuggcagggacgc

SEQ ID NO: 16055 - RNA, 18 nt, artificial
  Chemically synthesized
augguggugguugucucu

SEQ ID NO: 16056 - RNA, 18 nt, artificial
  Chemically synthesized
uucgaugccuucaucugc

SEQ ID NO: 16057 - RNA, 18 nt, artificial
  Chemically synthesized
acuggcaggcugcuggac

SEQ ID NO: 16058 - RNA, 18 nt, artificial
  Chemically synthesized
cagcagcaggaggaggcu

SEQ ID NO: 16059 - RNA, 18 nt, artificial
  Chemically synthesized
ccuugccaaggccuuguc

SEQ ID NO: 16060 - RNA, 18 nt, artificial
  Chemically synthesized
aaugaagaaagaguuccc

SEQ ID NO: 16061 - RNA, 18 nt, artificial
  Chemically synthesized
uugucccugcccugaaga

SEQ ID NO: 16062 - RNA, 18 nt, artificial
  Chemically synthesized
agaggugccgccggaugg

SEQ ID NO: 16063 - RNA, 18 nt, artificial
  Chemically synthesized
gcagcagcaggaggaggc

SEQ ID NO: 16064 - RNA, 18 nt, artificial
  Chemically synthesized
uuucgaugccuucaucug

SEQ ID NO: 16065 - RNA, 18 nt, artificial
  Chemically synthesized
gugccgccggaugguggu

SEQ ID NO: 16066 - RNA, 18 nt, artificial
  Chemically synthesized
uugaacgugcggacacag

SEQ ID NO: 16067 - RNA, 18 nt, artificial
  Chemically synthesized
aacgugcggacacaggug

SEQ ID NO: 16068 - RNA, 18 nt, artificial
  Chemically synthesized
cgugcggacacagguggc

SEQ ID NO: 16069 - RNA, 18 nt, artificial
  Chemically synthesized
caucgaaaagaggugccg

SEQ ID NO: 16070 - RNA, 18 nt, artificial
  Chemically synthesized
uaucuugaagcagcagca

SEQ ID NO: 16071 - RNA, 18 nt, artificial
  Chemically synthesized
acucagccucucuccagg

SEQ ID NO: 16072 - RNA, 18 nt, artificial
  Chemically synthesized
aagaggugccgccggaug

SEQ ID NO: 16073 - RNA, 18 nt, artificial
  Chemically synthesized
uggacucgccuugccaag

SEQ ID NO: 16074 - RNA, 18 nt, artificial
  Chemically synthesized
aaagaggugccgccggau

SEQ ID NO: 16075 - RNA, 18 nt, artificial
  Chemically synthesized
gcggacacagguggcggc

SEQ ID NO: 16076 - RNA, 18 nt, artificial
  Chemically synthesized
acaugcgagugcggcgcc

SEQ ID NO: 16077 - RNA, 18 nt, artificial
  Chemically synthesized
ucagaagcgacugauccc

SEQ ID NO: 16078 - RNA, 18 nt, artificial
  Chemically synthesized
gcugcaggaggucccggc

SEQ ID NO: 16079 - RNA, 18 nt, artificial
  Chemically synthesized
ugcuggacgccuggcagg

SEQ ID NO: 16080 - RNA, 18 nt, artificial
  Chemically synthesized
agccucucuccaggugcc

SEQ ID NO: 16081 - RNA, 18 nt, artificial
  Chemically synthesized
uugucucugaugauuacc

SEQ ID NO: 16082 - RNA, 18 nt, artificial
  Chemically synthesized
uugugcaggagaugaucc

SEQ ID NO: 16083 - RNA, 18 nt, artificial
  Chemically synthesized
uggcagggacgcccuggc

SEQ ID NO: 16084 - RNA, 18 nt, artificial
  Chemically synthesized
uauaucuugaagcagcag

SEQ ID NO: 16085 - RNA, 18 nt, artificial
  Chemically synthesized
aucuugguucuggacucg

SEQ ID NO: 16086 - RNA, 18 nt, artificial
  Chemically synthesized
ucuguucuugaacgugcg

SEQ ID NO: 16087 - RNA, 18 nt, artificial
  Chemically synthesized
gcuuaccaagcugggccg

SEQ ID NO: 16088 - RNA, 18 nt, artificial
  Chemically synthesized
augauccggcaacuggaa

SEQ ID NO: 16089 - RNA, 18 nt, artificial
  Chemically synthesized
cgaaaagaggugccgccg

SEQ ID NO: 16090 - RNA, 18 nt, artificial
  Chemically synthesized
ugggccgcgacgacgugc

SEQ ID NO: 16091 - RNA, 18 nt, artificial
  Chemically synthesized
cggacacagguggcggcc

SEQ ID NO: 16092 - RNA, 18 nt, artificial
  Chemically synthesized
aucgaaaagaggugccgc

SEQ ID NO: 16093 - RNA, 18 nt, artificial
  Chemically synthesized
aggcugcuggacgccugg

SEQ ID NO: 16094 - RNA, 18 nt, artificial
  Chemically synthesized
augcgagugcggcgccgc

SEQ ID NO: 16095 - RNA, 18 nt, artificial
  Chemically synthesized
uugccaaggccuuguccc

SEQ ID NO: 16096 - RNA, 18 nt, artificial
  Chemically synthesized
acgccuggcagggacgcc

SEQ ID NO: 16097 - RNA, 18 nt, artificial
  Chemically synthesized
ucuccuccacauccuccc

SEQ ID NO: 16098 - RNA, 18 nt, artificial
  Chemically synthesized
acagguggcggccgacug

SEQ ID NO: 16099 - RNA, 18 nt, artificial
  Chemically synthesized
aaaagaggugccgccgga

SEQ ID NO: 16100 - RNA, 18 nt, artificial
  Chemically synthesized
uggcaggcugcuggacgc

SEQ ID NO: 16101 - RNA, 18 nt, artificial
  Chemically synthesized
cugggccgcgacgacgug

SEQ ID NO: 16102 - RNA, 18 nt, artificial
  Chemically synthesized
aagccuuuacagguggcc

SEQ ID NO: 16103 - RNA, 18 nt, artificial
  Chemically synthesized
auguccugccuggcaccu

SEQ ID NO: 16104 - RNA, 18 nt, artificial
  Chemically synthesized
uugaagcagcagcaggag

SEQ ID NO: 16105 - RNA, 18 nt, artificial
  Chemically synthesized
cuuaccaagcugggccgc

SEQ ID NO: 16106 - RNA, 18 nt, artificial
  Chemically synthesized
accaagcugggccgcgac

SEQ ID NO: 16107 - RNA, 18 nt, artificial
  Chemically synthesized
aagcagcagcaggaggag

SEQ ID NO: 16108 - RNA, 18 nt, artificial
  Chemically synthesized
aacaugcgagugcggcgc

SEQ ID NO: 16109 - RNA, 18 nt, artificial
  Chemically synthesized
uuacagguggccgcugua

SEQ ID NO: 16110 - RNA, 18 nt, artificial
  Chemically synthesized
acucgccuugccaaggcc

SEQ ID NO: 16111 - RNA, 18 nt, artificial
  Chemically synthesized
gauguccugccuggcacc

SEQ ID NO: 16112 - RNA, 18 nt, artificial
  Chemically synthesized
aaggccuugucccugccc

SEQ ID NO: 16113 - RNA, 18 nt, artificial
  Chemically synthesized
aagcugggccgcgacgac

SEQ ID NO: 16114 - RNA, 18 nt, artificial
  Chemically synthesized
caaggccuugucccugcc

SEQ ID NO: 16115 - RNA, 18 nt, artificial
  Chemically synthesized
auggcugcaggagguccc

SEQ ID NO: 16116 - RNA, 18 nt, artificial
  Chemically synthesized
ugccgccggaugguggug

SEQ ID NO: 16117 - RNA, 18 nt, artificial
  Chemically synthesized
uccugccuggcaccugug

SEQ ID NO: 16118 - RNA, 18 nt, artificial
  Chemically synthesized
acacagguggcggccgac

SEQ ID NO: 16119 - RNA, 18 nt, artificial
  Chemically synthesized
ucaucgaaaagaggugcc

SEQ ID NO: 16120 - RNA, 18 nt, artificial
  Chemically synthesized
ucgaaaagaggugccgcc

SEQ ID NO: 16121 - RNA, 18 nt, artificial
  Chemically synthesized
uggcugcaggaggucccg

SEQ ID NO: 16122 - RNA, 18 nt, artificial
  Chemically synthesized
ugcaaauuuggucuggaa

SEQ ID NO: 16123 - RNA, 18 nt, artificial
  Chemically synthesized
uguggugaugcccgccag

SEQ ID NO: 16124 - RNA, 18 nt, artificial
  Chemically synthesized
gcagcacgucgucgcggc

SEQ ID NO: 16125 - RNA, 18 nt, artificial
  Chemically synthesized
ugcugucuacagcggcca

SEQ ID NO: 16126 - RNA, 18 nt, artificial
  Chemically synthesized
gugggacacugcugucua

SEQ ID NO: 16127 - RNA, 18 nt, artificial
  Chemically synthesized
accuggagagaggcugag

SEQ ID NO: 16128 - RNA, 18 nt, artificial
  Chemically synthesized
gauaguuugucuguucca

SEQ ID NO: 16129 - RNA, 18 nt, artificial
  Chemically synthesized
cuucucagccuccuccug

SEQ ID NO: 16130 - RNA, 18 nt, artificial
  Chemically synthesized
agggcgucccugccaggc

SEQ ID NO: 16131 - RNA, 18 nt, artificial
  Chemically synthesized
ccaccauccggcggcacc

SEQ ID NO: 16132 - RNA, 18 nt, artificial
  Chemically synthesized
gcauguugagagcagcca

SEQ ID NO: 16133 - RNA, 18 nt, artificial
  Chemically synthesized
ggaucagucgcuucugau

SEQ ID NO: 16134 - RNA, 18 nt, artificial
  Chemically synthesized
aggauguggaggagaccg

SEQ ID NO: 16135 - RNA, 18 nt, artificial
  Chemically synthesized
agcagcacgucgucgcgg

SEQ ID NO: 16136 - RNA, 18 nt, artificial
  Chemically synthesized
cggucagacacacacaac

SEQ ID NO: 16137 - RNA, 18 nt, artificial
  Chemically synthesized
ugggcaccuggagagagg

SEQ ID NO: 16138 - RNA, 18 nt, artificial
  Chemically synthesized
cugccaggcguccagcag

SEQ ID NO: 16139 - RNA, 18 nt, artificial
  Chemically synthesized
caccucuuuucgaugagc

SEQ ID NO: 16140 - RNA, 18 nt, artificial
  Chemically synthesized
gcuccagcagcacgucgu

SEQ ID NO: 16141 - RNA, 18 nt, artificial
  Chemically synthesized
uguccgcacguucaagaa

SEQ ID NO: 16142 - RNA, 18 nt, artificial
  Chemically synthesized
ggauguggaggagaccgg

SEQ ID NO: 16143 - RNA, 18 nt, artificial
  Chemically synthesized
ccggaucaucuccugcac

SEQ ID NO: 16144 - RNA, 18 nt, artificial
  Chemically synthesized
cagcagccugccaguggg

SEQ ID NO: 16145 - RNA, 18 nt, artificial
  Chemically synthesized
aaccaccaccauccggcg

SEQ ID NO: 16146 - RNA, 18 nt, artificial
  Chemically synthesized
agucgcuucugaugggca

SEQ ID NO: 16147 - RNA, 18 nt, artificial
  Chemically synthesized
cacaacuucagucgauag

SEQ ID NO: 16148 - RNA, 18 nt, artificial
  Chemically synthesized
ccgggaccuccugcagcc

SEQ ID NO: 16149 - RNA, 18 nt, artificial
  Chemically synthesized
gcaaggcgaguccagaac

SEQ ID NO: 16150 - RNA, 18 nt, artificial
  Chemically synthesized
ggaggauguggaggagac

SEQ ID NO: 16151 - RNA, 18 nt, artificial
  Chemically synthesized
aaggcgaguccagaacca

SEQ ID NO: 16152 - RNA, 18 nt, artificial
  Chemically synthesized
acaaggccuuggcaaggc

SEQ ID NO: 16153 - RNA, 18 nt, artificial
  Chemically synthesized
acacaacuucagucgaua

SEQ ID NO: 16154 - RNA, 18 nt, artificial
  Chemically synthesized
ucagccuccuccugcugc

SEQ ID NO: 16155 - RNA, 18 nt, artificial
  Chemically synthesized
caucgaaacgcucaggca

SEQ ID NO: 16156 - RNA, 18 nt, artificial
  Chemically synthesized
gacacaggugccaggcag

SEQ ID NO: 16157 - RNA, 18 nt, artificial
  Chemically synthesized
cuccagcagcacgucguc

SEQ ID NO: 16158 - RNA, 18 nt, artificial
  Chemically synthesized
augggcaccuggagagag

SEQ ID NO: 16159 - RNA, 18 nt, artificial
  Chemically synthesized
uuccuugcucugcaggua

SEQ ID NO: 16160 - RNA, 18 nt, artificial
  Chemically synthesized
agagaggcugagugcaaa

SEQ ID NO: 16161 - RNA, 18 nt, artificial
  Chemically synthesized
gcgaguccagaaccaaga

SEQ ID NO: 16162 - RNA, 18 nt, artificial
  Chemically synthesized
gacacacacaacuucagu

SEQ ID NO: 16163 - RNA, 18 nt, artificial
  Chemically synthesized
acaggugccaggcaggac

SEQ ID NO: 16164 - RNA, 18 nt, artificial
  Chemically synthesized
agcacgucgucgcggccc

SEQ ID NO: 16165 - RNA, 18 nt, artificial
  Chemically synthesized
gcagggacaaggccuugg

SEQ ID NO: 16166 - RNA, 18 nt, artificial
  Chemically synthesized
caggugccaggcaggaca

SEQ ID NO: 16167 - RNA, 18 nt, artificial
  Chemically synthesized
uucugaugggcaccugga

SEQ ID NO: 16168 - RNA, 18 nt, artificial
  Chemically synthesized
guccagaaccaagauuug

SEQ ID NO: 16169 - RNA, 18 nt, artificial
  Chemically synthesized
cagcggccaccuguaaag

SEQ ID NO: 16170 - RNA, 18 nt, artificial
  Chemically synthesized
cccagcuugguaagcagc

SEQ ID NO: 16171 - RNA, 18 nt, artificial
  Chemically synthesized
uccuccugcugcugcuuc

SEQ ID NO: 16172 - RNA, 18 nt, artificial
  Chemically synthesized
gucagacacacacaacuu

SEQ ID NO: 16173 - RNA, 18 nt, artificial
  Chemically synthesized
ugcuguccgugggacacu

SEQ ID NO: 16174 - RNA, 18 nt, artificial
  Chemically synthesized
uguuccaguugccggauc

SEQ ID NO: 16175 - RNA, 18 nt, artificial
  Chemically synthesized
aaccaagauuuggugcag

SEQ ID NO: 16176 - RNA, 18 nt, artificial
  Chemically synthesized
agcuccagcagcacgucg

SEQ ID NO: 16177 - RNA, 18 nt, artificial
  Chemically synthesized
cagcagcacgucgucgcg

SEQ ID NO: 16178 - RNA, 18 nt, artificial
  Chemically synthesized
agggcagggacaaggccu

SEQ ID NO: 16179 - RNA, 18 nt, artificial
  Chemically synthesized
aucgaaacgcucaggcau

SEQ ID NO: 16180 - RNA, 18 nt, artificial
  Chemically synthesized
gggaagggaggaugugga

SEQ ID NO: 16181 - RNA, 18 nt, artificial
  Chemically synthesized
acgucgucgcggcccagc

SEQ ID NO: 16182 - RNA, 18 nt, artificial
  Chemically synthesized
ccagcuugguaagcagcu

SEQ ID NO: 16183 - RNA, 18 nt, artificial
  Chemically synthesized
gcugagugcaaauuuggu

SEQ ID NO: 16184 - RNA, 18 nt, artificial
  Chemically synthesized
aggccuuggcaaggcgag

SEQ ID NO: 16185 - RNA, 18 nt, artificial
  Chemically synthesized
aacuucagucgauaguuu

SEQ ID NO: 16186 - RNA, 18 nt, artificial
  Chemically synthesized
gacaaccaccaccauccg

SEQ ID NO: 16187 - RNA, 18 nt, artificial
  Chemically synthesized
guaaucaucagagacaac

SEQ ID NO: 16188 - RNA, 18 nt, artificial
  Chemically synthesized
uccagcagccugccagug

SEQ ID NO: 16189 - RNA, 18 nt, artificial
  Chemically synthesized
uccagucggccgccaccu

SEQ ID NO: 16190 - RNA, 18 nt, artificial
  Chemically synthesized
cgucgucgcggcccagcu

SEQ ID NO: 16191 - RNA, 18 nt, artificial
  Chemically synthesized
acacaggugccaggcagg

SEQ ID NO: 16192 - RNA, 18 nt, artificial
  Chemically synthesized
gucgcuucugaugggcac

SEQ ID NO: 16193 - RNA, 18 nt, artificial
  Chemically synthesized
gcccagcuugguaagcag

SEQ ID NO: 16194 - RNA, 18 nt, artificial
  Chemically synthesized
gauguggaggagaccggg

SEQ ID NO: 16195 - RNA, 18 nt, artificial
  Chemically synthesized
caggcguccagcagccug

SEQ ID NO: 16196 - RNA, 18 nt, artificial
  Chemically synthesized
gucgauaguuugucuguu

SEQ ID NO: 16197 - RNA, 18 nt, artificial
  Chemically synthesized
cgucccugccaggcgucc

SEQ ID NO: 16198 - RNA, 18 nt, artificial
  Chemically synthesized
gucccugccaggcgucca

SEQ ID NO: 16199 - RNA, 18 nt, artificial
  Chemically synthesized
guguggugaugcccgcca

SEQ ID NO: 16200 - RNA, 18 nt, artificial
  Chemically synthesized
ggaagggaggauguggag

SEQ ID NO: 16201 - RNA, 18 nt, artificial
  Chemically synthesized
uccugcugcugcuucaag

SEQ ID NO: 16202 - RNA, 18 nt, artificial
  Chemically synthesized
ggcguccagcagccugcc

SEQ ID NO: 16203 - RNA, 18 nt, artificial
  Chemically synthesized
guccagucggccgccacc

SEQ ID NO: 16204 - RNA, 18 nt, artificial
  Chemically synthesized
caauagcagaugaaggca

SEQ ID NO: 16205 - RNA, 18 nt, artificial
  Chemically synthesized
ucccagcuccagcagcac

SEQ ID NO: 16206 - RNA, 18 nt, artificial
  Chemically synthesized
ggcgaguccagaaccaag

SEQ ID NO: 16207 - RNA, 18 nt, artificial
  Chemically synthesized
agucggccgccaccugug

SEQ ID NO: 16208 - RNA, 18 nt, artificial
  Chemically synthesized
ccagacacaggugccagg

SEQ ID NO: 16209 - RNA, 18 nt, artificial
  Chemically synthesized
gaguccagaaccaagauu

SEQ ID NO: 16210 - RNA, 18 nt, artificial
  Chemically synthesized
gagaggcugagugcaaau

SEQ ID NO: 16211 - RNA, 18 nt, artificial
  Chemically synthesized
gucccagcuccagcagca

SEQ ID NO: 16212 - RNA, 18 nt, artificial
  Chemically synthesized
ccgcacucgcauguugag

SEQ ID NO: 16213 - RNA, 18 nt, artificial
  Chemically synthesized
ccagcuccagcagcacgu

SEQ ID NO: 16214 - RNA, 18 nt, artificial
  Chemically synthesized
accaccaccauccggcgg

SEQ ID NO: 16215 - RNA, 18 nt, artificial
  Chemically synthesized
cugcugcugcuucaagau

SEQ ID NO: 16216 - RNA, 18 nt, artificial
  Chemically synthesized
caaggccuuggcaaggcg

SEQ ID NO: 16217 - RNA, 18 nt, artificial
  Chemically synthesized
ggaccuccugcagccaug

SEQ ID NO: 16218 - RNA, 18 nt, artificial
  Chemically synthesized
ggucccagcuccagcagc

SEQ ID NO: 16219 - RNA, 18 nt, artificial
  Chemically synthesized
gcuucugaugggcaccug

SEQ ID NO: 16220 - RNA, 18 nt, artificial
  Chemically synthesized
agcggccaccuguaaagg

SEQ ID NO: 16221 - RNA, 18 nt, artificial
  Chemically synthesized
ccagggcgucccugccag

SEQ ID NO: 16222 - RNA, 18 nt, artificial
  Chemically synthesized
ccgccaccuguguccgca

SEQ ID NO: 16223 - RNA, 18 nt, artificial
  Chemically synthesized
ggcaucgaaacgcucagg

SEQ ID NO: 16224 - RNA, 18 nt, artificial
  Chemically synthesized
cgcacucgcauguugaga

SEQ ID NO: 16225 - RNA, 18 nt, artificial
  Chemically synthesized
gaccagacacaggugcca

SEQ ID NO: 16226 - RNA, 18 nt, artificial
  Chemically synthesized
aaggccuuggcaaggcga

SEQ ID NO: 16227 - RNA, 18 nt, artificial
  Chemically synthesized
cuucagucgauaguuugu

SEQ ID NO: 16228 - RNA, 18 nt, artificial
  Chemically synthesized
cagcuccagcagcacguc

SEQ ID NO: 16229 - RNA, 18 nt, artificial
  Chemically synthesized
gccgcacucgcauguuga

SEQ ID NO: 16230 - RNA, 18 nt, artificial
  Chemically synthesized
gcggccaccuguaaaggc

SEQ ID NO: 16231 - RNA, 18 nt, artificial
  Chemically synthesized
cggaucaucuccugcaca

SEQ ID NO: 16232 - RNA, 18 nt, artificial
  Chemically synthesized
ccuguguccgcacguuca

SEQ ID NO: 16233 - RNA, 18 nt, artificial
  Chemically synthesized
cgccgcacucgcauguug

SEQ ID NO: 16234 - RNA, 18 nt, artificial
  Chemically synthesized
acacacaacuucagucga

SEQ ID NO: 16235 - RNA, 18 nt, artificial
  Chemically synthesized
cagcacgucgucgcggcc

SEQ ID NO: 16236 - RNA, 18 nt, artificial
  Chemically synthesized
gaaacgcucaggcauaug

SEQ ID NO: 16237 - RNA, 18 nt, artificial
  Chemically synthesized
cacacaacuucagucgau

SEQ ID NO: 16238 - RNA, 18 nt, artificial
  Chemically synthesized
ucggccgccaccuguguc

SEQ ID NO: 16239 - RNA, 18 nt, artificial
  Chemically synthesized
accauccggcggcaccuc

SEQ ID NO: 16240 - RNA, 18 nt, artificial
  Chemically synthesized
ccaccuguguccgcacgu

SEQ ID NO: 16241 - RNA, 18 nt, artificial
  Chemically synthesized
caguugccggaucuccaa

SEQ ID NO: 16242 - RNA, 18 nt, artificial
  Chemically synthesized
agacacaggugccaggca

SEQ ID NO: 16243 - RNA, 18 nt, artificial
  Chemically synthesized
cgccaccuguguccgcac

SEQ ID NO: 16244 - RNA, 18 nt, artificial
  Chemically synthesized
ugcugggucccagcucca

SEQ ID NO: 16245 - RNA, 18 nt, artificial
  Chemically synthesized
gggcaauagcagaugaag

SEQ ID NO: 16246 - RNA, 18 nt, artificial
  Chemically synthesized
gagagaggcugagugcaa

SEQ ID NO: 16247 - RNA, 18 nt, artificial
  Chemically synthesized
gcagacagugaugaaccu

SEQ ID NO: 16248 - RNA, 18 nt, artificial
  Chemically synthesized
aggcgccagggcgucccu

SEQ ID NO: 16249 - RNA, 18 nt, artificial
  Chemically synthesized
cagggcgucccugccagg

SEQ ID NO: 16250 - RNA, 18 nt, artificial
  Chemically synthesized
ggacaaggccuuggcaag

SEQ ID NO: 16251 - RNA, 18 nt, artificial
  Chemically synthesized
caccuggagagaggcuga

SEQ ID NO: 16252 - RNA, 18 nt, artificial
  Chemically synthesized
caccauccggcggcaccu

SEQ ID NO: 16253 - RNA, 18 nt, artificial
  Chemically synthesized
cggcgccgcacucgcaug

SEQ ID NO: 16254 - RNA, 18 nt, artificial
  Chemically synthesized
agggaggauguggaggag

SEQ ID NO: 16255 - RNA, 18 nt, artificial
  Chemically synthesized
gaucaucuccugcacaaa

SEQ ID NO: 16256 - RNA, 18 nt, artificial
  Chemically synthesized
gccaccuguaaaggcuuc

SEQ ID NO: 16257 - RNA, 18 nt, artificial
  Chemically synthesized
gcaccucuuuucgaugag

SEQ ID NO: 16258 - RNA, 18 nt, artificial
  Chemically synthesized
ucgaaacgcucaggcaua

SEQ ID NO: 16259 - RNA, 18 nt, artificial
  Chemically synthesized
aggcgaguccagaaccaa

SEQ ID NO: 16260 - RNA, 18 nt, artificial
  Chemically synthesized
ucgcggcccagcuuggua

SEQ ID NO: 16261 - RNA, 18 nt, artificial
  Chemically synthesized
ggcccagcuugguaagca

SEQ ID NO: 16262 - RNA, 18 nt, artificial
  Chemically synthesized
gguccagucggccgccac

SEQ ID NO: 16263 - RNA, 18 nt, artificial
  Chemically synthesized
agggacaaggccuuggca

SEQ ID NO: 16264 - RNA, 18 nt, artificial
  Chemically synthesized
ccuccuccugcugcugcu

SEQ ID NO: 16265 - RNA, 18 nt, artificial
  Chemically synthesized
gcgucccugccaggcguc

SEQ ID NO: 16266 - RNA, 18 nt, artificial
  Chemically synthesized
agagacaaccaccaccau

SEQ ID NO: 16267 - RNA, 18 nt, artificial
  Chemically synthesized
gcagaugaaggcaucgaa

SEQ ID NO: 16268 - RNA, 18 nt, artificial
  Chemically synthesized
guccagcagccugccagu

SEQ ID NO: 16269 - RNA, 18 nt, artificial
  Chemically synthesized
agccuccuccugcugcug

SEQ ID NO: 16270 - RNA, 18 nt, artificial
  Chemically synthesized
gacaaggccuuggcaagg

SEQ ID NO: 16271 - RNA, 18 nt, artificial
  Chemically synthesized
gggaacucuuucuucauu

SEQ ID NO: 16272 - RNA, 18 nt, artificial
  Chemically synthesized
ucuucagggcagggacaa

SEQ ID NO: 16273 - RNA, 18 nt, artificial
  Chemically synthesized
ccauccggcggcaccucu

SEQ ID NO: 16274 - RNA, 18 nt, artificial
  Chemically synthesized
gccuccuccugcugcugc

SEQ ID NO: 16275 - RNA, 18 nt, artificial
  Chemically synthesized
cagaugaaggcaucgaaa

SEQ ID NO: 16276 - RNA, 18 nt, artificial
  Chemically synthesized
accaccauccggcggcac

SEQ ID NO: 16277 - RNA, 18 nt, artificial
  Chemically synthesized
cuguguccgcacguucaa

SEQ ID NO: 16278 - RNA, 18 nt, artificial
  Chemically synthesized
caccuguguccgcacguu

SEQ ID NO: 16279 - RNA, 18 nt, artificial
  Chemically synthesized
gccaccuguguccgcacg

SEQ ID NO: 16280 - RNA, 18 nt, artificial
  Chemically synthesized
cggcaccucuuuucgaug

SEQ ID NO: 16281 - RNA, 18 nt, artificial
  Chemically synthesized
ugcugcugcuucaagaua

SEQ ID NO: 16282 - RNA, 18 nt, artificial
  Chemically synthesized
ccuggagagaggcugagu

SEQ ID NO: 16283 - RNA, 18 nt, artificial
  Chemically synthesized
cauccggcggcaccucuu

SEQ ID NO: 16284 - RNA, 18 nt, artificial
  Chemically synthesized
cuuggcaaggcgagucca

SEQ ID NO: 16285 - RNA, 18 nt, artificial
  Chemically synthesized
auccggcggcaccucuuu

SEQ ID NO: 16286 - RNA, 18 nt, artificial
  Chemically synthesized
gccgccaccuguguccgc

SEQ ID NO: 16287 - RNA, 18 nt, artificial
  Chemically synthesized
ggcgccgcacucgcaugu

SEQ ID NO: 16288 - RNA, 18 nt, artificial
  Chemically synthesized
gggaucagucgcuucuga

SEQ ID NO: 16289 - RNA, 18 nt, artificial
  Chemically synthesized
gccgggaccuccugcagc

SEQ ID NO: 16290 - RNA, 18 nt, artificial
  Chemically synthesized
ccugccaggcguccagca

SEQ ID NO: 16291 - RNA, 18 nt, artificial
  Chemically synthesized
ggcaccuggagagaggcu

SEQ ID NO: 16292 - RNA, 18 nt, artificial
  Chemically synthesized
gguaaucaucagagacaa

SEQ ID NO: 16293 - RNA, 18 nt, artificial
  Chemically synthesized
ggaucaucuccugcacaa

SEQ ID NO: 16294 - RNA, 18 nt, artificial
  Chemically synthesized
gccagggcgucccugcca

SEQ ID NO: 16295 - RNA, 18 nt, artificial
  Chemically synthesized
cugcugcuucaagauaua

SEQ ID NO: 16296 - RNA, 18 nt, artificial
  Chemically synthesized
cgaguccagaaccaagau

SEQ ID NO: 16297 - RNA, 18 nt, artificial
  Chemically synthesized
cgcacguucaagaacaga

SEQ ID NO: 16298 - RNA, 18 nt, artificial
  Chemically synthesized
cggcccagcuugguaagc

SEQ ID NO: 16299 - RNA, 18 nt, artificial
  Chemically synthesized
uuccaguugccggaucau

SEQ ID NO: 16300 - RNA, 18 nt, artificial
  Chemically synthesized
cggcggcaccucuuuucg

SEQ ID NO: 16301 - RNA, 18 nt, artificial
  Chemically synthesized
gcacgucgucgcggccca

SEQ ID NO: 16302 - RNA, 18 nt, artificial
  Chemically synthesized
ggccgccaccuguguccg

SEQ ID NO: 16303 - RNA, 18 nt, artificial
  Chemically synthesized
gcggcaccucuuuucgau

SEQ ID NO: 16304 - RNA, 18 nt, artificial
  Chemically synthesized
ccaggcguccagcagccu

SEQ ID NO: 16305 - RNA, 18 nt, artificial
  Chemically synthesized
gcggcgccgcacucgcau

SEQ ID NO: 16306 - RNA, 18 nt, artificial
  Chemically synthesized
gggacaaggccuuggcaa

SEQ ID NO: 16307 - RNA, 18 nt, artificial
  Chemically synthesized
ggcgucccugccaggcgu

SEQ ID NO: 16308 - RNA, 18 nt, artificial
  Chemically synthesized
gggaggauguggaggaga

SEQ ID NO: 16309 - RNA, 18 nt, artificial
  Chemically synthesized
cagucggccgccaccugu

SEQ ID NO: 16310 - RNA, 18 nt, artificial
  Chemically synthesized
uccggcggcaccucuuuu

SEQ ID NO: 16311 - RNA, 18 nt, artificial
  Chemically synthesized
gcguccagcagccugcca

SEQ ID NO: 16312 - RNA, 18 nt, artificial
  Chemically synthesized
cacgucgucgcggcccag

SEQ ID NO: 16313 - RNA, 18 nt, artificial
  Chemically synthesized
ggccaccuguaaaggcuu

SEQ ID NO: 16314 - RNA, 18 nt, artificial
  Chemically synthesized
aggugccaggcaggacau

SEQ ID NO: 16315 - RNA, 18 nt, artificial
  Chemically synthesized
cuccugcugcugcuucaa

SEQ ID NO: 16316 - RNA, 18 nt, artificial
  Chemically synthesized
gcggcccagcuugguaag

SEQ ID NO: 16317 - RNA, 18 nt, artificial
  Chemically synthesized
gucgcggcccagcuuggu

SEQ ID NO: 16318 - RNA, 18 nt, artificial
  Chemically synthesized
cuccuccugcugcugcuu

SEQ ID NO: 16319 - RNA, 18 nt, artificial
  Chemically synthesized
gcgccgcacucgcauguu

SEQ ID NO: 16320 - RNA, 18 nt, artificial
  Chemically synthesized
uacagcggccaccuguaa

SEQ ID NO: 16321 - RNA, 18 nt, artificial
  Chemically synthesized
ggccuuggcaaggcgagu

SEQ ID NO: 16322 - RNA, 18 nt, artificial
  Chemically synthesized
ggugccaggcaggacauc

SEQ ID NO: 16323 - RNA, 18 nt, artificial
  Chemically synthesized
gggcagggacaaggccuu

SEQ ID NO: 16324 - RNA, 18 nt, artificial
  Chemically synthesized
gucgucgcggcccagcuu

SEQ ID NO: 16325 - RNA, 18 nt, artificial
  Chemically synthesized
ggcagggacaaggccuug

SEQ ID NO: 16326 - RNA, 18 nt, artificial
  Chemically synthesized
gggaccuccugcagccau

SEQ ID NO: 16327 - RNA, 18 nt, artificial
  Chemically synthesized
caccaccauccggcggca

SEQ ID NO: 16328 - RNA, 18 nt, artificial
  Chemically synthesized
cacaggugccaggcagga

SEQ ID NO: 16329 - RNA, 18 nt, artificial
  Chemically synthesized
gucggccgccaccugugu

SEQ ID NO: 16330 - RNA, 18 nt, artificial
  Chemically synthesized
ggcaccucuuuucgauga

SEQ ID NO: 16331 - RNA, 18 nt, artificial
  Chemically synthesized
ggcggcaccucuuuucga

SEQ ID NO: 16332 - RNA, 18 nt, Artificial Sequence
  Chemically synthesized
cgggaccuccugcagcca

SEQ ID NO: 16333 - RNA, 19 nt, artificial
  Chemically synthesized
ggaucucucuagaggcauu

SEQ ID NO: 16334 - RNA, 19 nt, artificial
  Chemically synthesized
cggaacagaaauucuauaa

SEQ ID NO: 16335 - RNA, 19 nt, artificial
  Chemically synthesized
cucucuauuucugggugaa

SEQ ID NO: 16336 - RNA, 19 nt, artificial
  Chemically synthesized
agcccuucauuuaggacaa

SEQ ID NO: 16337 - RNA, 19 nt, artificial
  Chemically synthesized
ggguggucagaacuggaua

SEQ ID NO: 16338 - RNA, 19 nt, artificial
  Chemically synthesized
caucggaacagaaauucua

SEQ ID NO: 16339 - RNA, 19 nt, artificial
  Chemically synthesized
ccaacuuucuguagaagau

SEQ ID NO: 16340 - RNA, 19 nt, artificial
  Chemically synthesized
ccuggaaucaucaucggaa

SEQ ID NO: 16341 - RNA, 19 nt, artificial
  Chemically synthesized
cuggaacagugaaugggua

SEQ ID NO: 16342 - RNA, 19 nt, artificial
  Chemically synthesized
gggucgccagacuguguca

SEQ ID NO: 16343 - RNA, 19 nt, artificial
  Chemically synthesized
cccuguggacaguggaaga

SEQ ID NO: 16344 - RNA, 19 nt, artificial
  Chemically synthesized
gaaucaucaucggaacaga

SEQ ID NO: 16345 - RNA, 19 nt, artificial
  Chemically synthesized
cuuucaucauccuacuucu

SEQ ID NO: 16346 - RNA, 19 nt, artificial
  Chemically synthesized
gauaccaccucuccaaaua

SEQ ID NO: 16347 - RNA, 19 nt, artificial
  Chemically synthesized
ggguauugcuacggucuuu

SEQ ID NO: 16348 - RNA, 19 nt, artificial
  Chemically synthesized
uguggacaguggaagauga

SEQ ID NO: 16349 - RNA, 19 nt, artificial
  Chemically synthesized
gcagaaccuggaacaguga

SEQ ID NO: 16350 - RNA, 19 nt, artificial
  Chemically synthesized
gaagauaccaccucuccaa

SEQ ID NO: 16351 - RNA, 19 nt, artificial
  Chemically synthesized
cagccuaccuccagagcua

SEQ ID NO: 16352 - RNA, 19 nt, artificial
  Chemically synthesized
ccauagaccacucagcuuu

SEQ ID NO: 16353 - RNA, 19 nt, artificial
  Chemically synthesized
ggacacugggcgugcagaa

SEQ ID NO: 16354 - RNA, 19 nt, artificial
  Chemically synthesized
cccuucauuuaggacaaaa

SEQ ID NO: 16355 - RNA, 19 nt, artificial
  Chemically synthesized
caucaucggaacagaaauu

SEQ ID NO: 16356 - RNA, 19 nt, artificial
  Chemically synthesized
ccagcagccuuuccacagu

SEQ ID NO: 16357 - RNA, 19 nt, artificial
  Chemically synthesized
cagccuuuccacagucacu

SEQ ID NO: 16358 - RNA, 19 nt, artificial
  Chemically synthesized
ccugcucugucaaagacca

SEQ ID NO: 16359 - RNA, 19 nt, artificial
  Chemically synthesized
ggugaagggucuugguggu

SEQ ID NO: 16360 - RNA, 19 nt, artificial
  Chemically synthesized
cccugcggguucgggagaa

SEQ ID NO: 16361 - RNA, 19 nt, artificial
  Chemically synthesized
cccacagccagcagccuuu

SEQ ID NO: 16362 - RNA, 19 nt, artificial
  Chemically synthesized
ggcuggacgaacacuccca

SEQ ID NO: 16363 - RNA, 19 nt, artificial
  Chemically synthesized
ccauguggaggaaggaaca

SEQ ID NO: 16364 - RNA, 19 nt, artificial
  Chemically synthesized
caacuuucuguagaagaua

SEQ ID NO: 16365 - RNA, 19 nt, artificial
  Chemically synthesized
ccaccucuccaaauaccaa

SEQ ID NO: 16366 - RNA, 19 nt, artificial
  Chemically synthesized
aucggaacagaaauucuau

SEQ ID NO: 16367 - RNA, 19 nt, artificial
  Chemically synthesized
gccaggagccugaggagau

SEQ ID NO: 16368 - RNA, 19 nt, artificial
  Chemically synthesized
gcccuucauuuaggacaaa

SEQ ID NO: 16369 - RNA, 19 nt, artificial
  Chemically synthesized
ucggaacagaaauucuaua

SEQ ID NO: 16370 - RNA, 19 nt, artificial
  Chemically synthesized
cccagaucuucgccaggaa

SEQ ID NO: 16371 - RNA, 19 nt, artificial
  Chemically synthesized
gcaccaacuacccagugga

SEQ ID NO: 16372 - RNA, 19 nt, artificial
  Chemically synthesized
cgguguuuacaauuccaau

SEQ ID NO: 16373 - RNA, 19 nt, artificial
  Chemically synthesized
gggagaagcuggaggcccu

SEQ ID NO: 16374 - RNA, 19 nt, artificial
  Chemically synthesized
agaaccuggaacagugaau

SEQ ID NO: 16375 - RNA, 19 nt, artificial
  Chemically synthesized
ccggaucccugaucugcuu

SEQ ID NO: 16376 - RNA, 19 nt, artificial
  Chemically synthesized
ggguucgggagaagcugga

SEQ ID NO: 16377 - RNA, 19 nt, artificial
  Chemically synthesized
ggauacgguguuuacaauu

SEQ ID NO: 16378 - RNA, 19 nt, artificial
  Chemically synthesized
agcagccuuuccacaguca

SEQ ID NO: 16379 - RNA, 19 nt, artificial
  Chemically synthesized
ggcuggugcggcuggacga

SEQ ID NO: 16380 - RNA, 19 nt, artificial
  Chemically synthesized
ccaccuucugcgaggauuu

SEQ ID NO: 16381 - RNA, 19 nt, artificial
  Chemically synthesized
uccggacgcuccaguccaa

SEQ ID NO: 16382 - RNA, 19 nt, artificial
  Chemically synthesized
cgacauucuaggugcagca

SEQ ID NO: 16383 - RNA, 19 nt, artificial
  Chemically synthesized
gacgaacacucccagaucu

SEQ ID NO: 16384 - RNA, 19 nt, artificial
  Chemically synthesized
ucaucaucggaacagaaau

SEQ ID NO: 16385 - RNA, 19 nt, artificial
  Chemically synthesized
gacgcaggaggcagaauga

SEQ ID NO: 16386 - RNA, 19 nt, artificial
  Chemically synthesized
gccauagaccacucagcuu

SEQ ID NO: 16387 - RNA, 19 nt, artificial
  Chemically synthesized
cuucgacauucuaggugca

SEQ ID NO: 16388 - RNA, 19 nt, artificial
  Chemically synthesized
aggugaaccaagccaugau

SEQ ID NO: 16389 - RNA, 19 nt, artificial
  Chemically synthesized
cagcuuucaucauccuacu

SEQ ID NO: 16390 - RNA, 19 nt, artificial
  Chemically synthesized
ggcugaacaaccacaugug

SEQ ID NO: 16391 - RNA, 19 nt, artificial
  Chemically synthesized
aucugaagcacaaacugaa

SEQ ID NO: 16392 - RNA, 19 nt, artificial
  Chemically synthesized
ccuggaacagugaaugggu

SEQ ID NO: 16393 - RNA, 19 nt, artificial
  Chemically synthesized
gacaagcucuuguaucuga

SEQ ID NO: 16394 - RNA, 19 nt, artificial
  Chemically synthesized
cucuauuucugggugaagg

SEQ ID NO: 16395 - RNA, 19 nt, artificial
  Chemically synthesized
gccugagccugcaccaggu

SEQ ID NO: 16396 - RNA, 19 nt, artificial
  Chemically synthesized
ucuuguaucugaagcacaa

SEQ ID NO: 16397 - RNA, 19 nt, artificial
  Chemically synthesized
gguguuuacaauuccaauc

SEQ ID NO: 16398 - RNA, 19 nt, artificial
  Chemically synthesized
gggagcccuucauuuagga

SEQ ID NO: 16399 - RNA, 19 nt, artificial
  Chemically synthesized
ggagauugccagcccacca

SEQ ID NO: 16400 - RNA, 19 nt, artificial
  Chemically synthesized
ugaacaaccacauguggaa

SEQ ID NO: 16401 - RNA, 19 nt, artificial
  Chemically synthesized
ccuuguucagcucaccuga

SEQ ID NO: 16402 - RNA, 19 nt, artificial
  Chemically synthesized
aggucaucugccacuuuca

SEQ ID NO: 16403 - RNA, 19 nt, artificial
  Chemically synthesized
caauuccaaucucucuauu

SEQ ID NO: 16404 - RNA, 19 nt, artificial
  Chemically synthesized
ccagcaagcucugugacga

SEQ ID NO: 16405 - RNA, 19 nt, artificial
  Chemically synthesized
gcuccugcagaaccuggaa

SEQ ID NO: 16406 - RNA, 19 nt, artificial
  Chemically synthesized
aggacaagcucuuguaucu

SEQ ID NO: 16407 - RNA, 19 nt, artificial
  Chemically synthesized
gccaugaugagcaaccuca

SEQ ID NO: 16408 - RNA, 19 nt, artificial
  Chemically synthesized
gccaggacaagcucuugua

SEQ ID NO: 16409 - RNA, 19 nt, artificial
  Chemically synthesized
cagaaccuggaacagugaa

SEQ ID NO: 16410 - RNA, 19 nt, artificial
  Chemically synthesized
guccgggagcccuucauuu

SEQ ID NO: 16411 - RNA, 19 nt, artificial
  Chemically synthesized
gggugaagggucuuggugg

SEQ ID NO: 16412 - RNA, 19 nt, artificial
  Chemically synthesized
cuuguaucugaagcacaaa

SEQ ID NO: 16413 - RNA, 19 nt, artificial
  Chemically synthesized
cucccaccauccucggcuu

SEQ ID NO: 16414 - RNA, 19 nt, artificial
  Chemically synthesized
aaucaucaucggaacagaa

SEQ ID NO: 16415 - RNA, 19 nt, artificial
  Chemically synthesized
uccgggagcccuucauuua

SEQ ID NO: 16416 - RNA, 19 nt, artificial
  Chemically synthesized
cccuggaaucaucaucgga

SEQ ID NO: 16417 - RNA, 19 nt, artificial
  Chemically synthesized
cuggaaucaucaucggaac

SEQ ID NO: 16418 - RNA, 19 nt, artificial
  Chemically synthesized
gggcugaacaaccacaugu

SEQ ID NO: 16419 - RNA, 19 nt, artificial
  Chemically synthesized
ggaacagaaauucuauaac

SEQ ID NO: 16420 - RNA, 19 nt, artificial
  Chemically synthesized
gguggagccagcgcccuca

SEQ ID NO: 16421 - RNA, 19 nt, artificial
  Chemically synthesized
gccacuuucaggacauugu

SEQ ID NO: 16422 - RNA, 19 nt, artificial
  Chemically synthesized
agcucuuguaucugaagca

SEQ ID NO: 16423 - RNA, 19 nt, artificial
  Chemically synthesized
ggacgccauagaccacuca

SEQ ID NO: 16424 - RNA, 19 nt, artificial
  Chemically synthesized
guuuacaauuccaaucucu

SEQ ID NO: 16425 - RNA, 19 nt, artificial
  Chemically synthesized
accaagccaugaugagcaa

SEQ ID NO: 16426 - RNA, 19 nt, artificial
  Chemically synthesized
ccaugguucuccugaagcu

SEQ ID NO: 16427 - RNA, 19 nt, artificial
  Chemically synthesized
ugcagaaccuggaacagug

SEQ ID NO: 16428 - RNA, 19 nt, artificial
  Chemically synthesized
cucuuguaucugaagcaca

SEQ ID NO: 16429 - RNA, 19 nt, artificial
  Chemically synthesized
cuuccuagcgccuucgaca

SEQ ID NO: 16430 - RNA, 19 nt, artificial
  Chemically synthesized
ggcagcuccugcagaaccu

SEQ ID NO: 16431 - RNA, 19 nt, artificial
  Chemically synthesized
ggaagguggccaacaccuu

SEQ ID NO: 16432 - RNA, 19 nt, artificial
  Chemically synthesized
gagccugaggagaugagcu

SEQ ID NO: 16433 - RNA, 19 nt, artificial
  Chemically synthesized
ccaacuacccaguggagug

SEQ ID NO: 16434 - RNA, 19 nt, artificial
  Chemically synthesized
ggcuuucaggguggucaga

SEQ ID NO: 16435 - RNA, 19 nt, artificial
  Chemically synthesized
auuucugggugaagggucu

SEQ ID NO: 16436 - RNA, 19 nt, artificial
  Chemically synthesized
ccgccacccuuucccacuu

SEQ ID NO: 16437 - RNA, 19 nt, artificial
  Chemically synthesized
uggugcggcuggacgaaca

SEQ ID NO: 16438 - RNA, 19 nt, artificial
  Chemically synthesized
accugcuggcugaggagaa

SEQ ID NO: 16439 - RNA, 19 nt, artificial
  Chemically synthesized
caguggaagaugaggucau

SEQ ID NO: 16440 - RNA, 19 nt, artificial
  Chemically synthesized
ccugcaccaggugaaccaa

SEQ ID NO: 16441 - RNA, 19 nt, artificial
  Chemically synthesized
ggacaguggaagaugaggu

SEQ ID NO: 16442 - RNA, 19 nt, artificial
  Chemically synthesized
ccacauguggaaccagaga

SEQ ID NO: 16443 - RNA, 19 nt, artificial
  Chemically synthesized
caggaucucucuagaggca

SEQ ID NO: 16444 - RNA, 19 nt, artificial
  Chemically synthesized
ccagaaaccagcaccaacu

SEQ ID NO: 16445 - RNA, 19 nt, artificial
  Chemically synthesized
caggagccugaggagauga

SEQ ID NO: 16446 - RNA, 19 nt, artificial
  Chemically synthesized
augccaugguucuccugaa

SEQ ID NO: 16447 - RNA, 19 nt, artificial
  Chemically synthesized
ucucucuauuucuggguga

SEQ ID NO: 16448 - RNA, 19 nt, artificial
  Chemically synthesized
ggccauguggaggaaggaa

SEQ ID NO: 16449 - RNA, 19 nt, artificial
  Chemically synthesized
gccugcaccaggugaacca

SEQ ID NO: 16450 - RNA, 19 nt, artificial
  Chemically synthesized
ggagcauccggacgcucca

SEQ ID NO: 16451 - RNA, 19 nt, artificial
  Chemically synthesized
agagcuacuuguccuacca

SEQ ID NO: 16452 - RNA, 19 nt, artificial
  Chemically synthesized
ggacgaacacucccagauc

SEQ ID NO: 16453 - RNA, 19 nt, artificial
  Chemically synthesized
caagggugcucccugcgau

SEQ ID NO: 16454 - RNA, 19 nt, artificial
  Chemically synthesized
uguagaagauaccaccucu

SEQ ID NO: 16455 - RNA, 19 nt, artificial
  Chemically synthesized
gguggucagaacuggauac

SEQ ID NO: 16456 - RNA, 19 nt, artificial
  Chemically synthesized
ccugcgggaacagagccaa

SEQ ID NO: 16457 - RNA, 19 nt, artificial
  Chemically synthesized
gagcccuucauuuaggaca

SEQ ID NO: 16458 - RNA, 19 nt, artificial
  Chemically synthesized
ugagccugcaccaggugaa

SEQ ID NO: 16459 - RNA, 19 nt, artificial
  Chemically synthesized
aucaucaucggaacagaaa

SEQ ID NO: 16460 - RNA, 19 nt, artificial
  Chemically synthesized
caggguggucagaacugga

SEQ ID NO: 16461 - RNA, 19 nt, artificial
  Chemically synthesized
ggacgcuccaguccaaucu

SEQ ID NO: 16462 - RNA, 19 nt, artificial
  Chemically synthesized
cccgagcccugcgggaaca

SEQ ID NO: 16463 - RNA, 19 nt, artificial
  Chemically synthesized
cuggauacgguguuuacaa

SEQ ID NO: 16464 - RNA, 19 nt, artificial
  Chemically synthesized
acaauuccaaucucucuau

SEQ ID NO: 16465 - RNA, 19 nt, artificial
  Chemically synthesized
ggcuuuugggagccacaug

SEQ ID NO: 16466 - RNA, 19 nt, artificial
  Chemically synthesized
ccacgccagggcagacgaa

SEQ ID NO: 16467 - RNA, 19 nt, artificial
  Chemically synthesized
cacuccaacuuucuguaga

SEQ ID NO: 16468 - RNA, 19 nt, artificial
  Chemically synthesized
agauaccaccucuccaaau

SEQ ID NO: 16469 - RNA, 19 nt, artificial
  Chemically synthesized
ucuauaacuuugugauccu

SEQ ID NO: 16470 - RNA, 19 nt, artificial
  Chemically synthesized
acaagcucuuguaucugaa

SEQ ID NO: 16471 - RNA, 19 nt, artificial
  Chemically synthesized
cuuucaggguggucagaac

SEQ ID NO: 16472 - RNA, 19 nt, artificial
  Chemically synthesized
gcaacuuggaaaucagcca

SEQ ID NO: 16473 - RNA, 19 nt, artificial
  Chemically synthesized
agaagauaccaccucucca

SEQ ID NO: 16474 - RNA, 19 nt, artificial
  Chemically synthesized
gcuuucaggguggucagaa

SEQ ID NO: 16475 - RNA, 19 nt, artificial
  Chemically synthesized
agccacaugucauuuggga

SEQ ID NO: 16476 - RNA, 19 nt, artificial
  Chemically synthesized
ggugaaccaagccaugaug

SEQ ID NO: 16477 - RNA, 19 nt, artificial
  Chemically synthesized
ggcccagcaagcucuguga

SEQ ID NO: 16478 - RNA, 19 nt, artificial
  Chemically synthesized
cccaggacccaguggcgca

SEQ ID NO: 16479 - RNA, 19 nt, artificial
  Chemically synthesized
cacagauggagcagcucca

SEQ ID NO: 16480 - RNA, 19 nt, artificial
  Chemically synthesized
acgccagggcagacgaaca

SEQ ID NO: 16481 - RNA, 19 nt, artificial
  Chemically synthesized
gggaacagagccaacaccu

SEQ ID NO: 16482 - RNA, 19 nt, artificial
  Chemically synthesized
gccagcaacuuggaaauca

SEQ ID NO: 16483 - RNA, 19 nt, artificial
  Chemically synthesized
agcagcuccagguggcuuu

SEQ ID NO: 16484 - RNA, 19 nt, artificial
  Chemically synthesized
ggcacugaacgcagccuac

SEQ ID NO: 16485 - RNA, 19 nt, artificial
  Chemically synthesized
auaacuuugugauccucca

SEQ ID NO: 16486 - RNA, 19 nt, artificial
  Chemically synthesized
ggucagaacuggauacggu

SEQ ID NO: 16487 - RNA, 19 nt, artificial
  Chemically synthesized
gcgaugaugcccuggcuuu

SEQ ID NO: 16488 - RNA, 19 nt, artificial
  Chemically synthesized
ggacguggccuaccaggaa

SEQ ID NO: 16489 - RNA, 19 nt, artificial
  Chemically synthesized
ccuucauuuaggacaaaac

SEQ ID NO: 16490 - RNA, 19 nt, artificial
  Chemically synthesized
cggacuggagccaagggug

SEQ ID NO: 16491 - RNA, 19 nt, artificial
  Chemically synthesized
guuucggacuggagccaag

SEQ ID NO: 16492 - RNA, 19 nt, artificial
  Chemically synthesized
cuagcgccuucgacauucu

SEQ ID NO: 16493 - RNA, 19 nt, artificial
  Chemically synthesized
cggcacugaacgcagccua

SEQ ID NO: 16494 - RNA, 19 nt, artificial
  Chemically synthesized
ugcaggacgccauagacca

SEQ ID NO: 16495 - RNA, 19 nt, artificial
  Chemically synthesized
ggaggaaggaacaggacac

SEQ ID NO: 16496 - RNA, 19 nt, artificial
  Chemically synthesized
gugaaccaagccaugauga

SEQ ID NO: 16497 - RNA, 19 nt, artificial
  Chemically synthesized
gaccacucagcuuucauca

SEQ ID NO: 16498 - RNA, 19 nt, artificial
  Chemically synthesized
guggcuuuugggagccaca

SEQ ID NO: 16499 - RNA, 19 nt, artificial
  Chemically synthesized
cuggcugaggagaagcugu

SEQ ID NO: 16500 - RNA, 19 nt, artificial
  Chemically synthesized
gggacacugggcgugcaga

SEQ ID NO: 16501 - RNA, 19 nt, artificial
  Chemically synthesized
ccagacgccacuccaacuu

SEQ ID NO: 16502 - RNA, 19 nt, artificial
  Chemically synthesized
guguuuacaauuccaaucu

SEQ ID NO: 16503 - RNA, 19 nt, artificial
  Chemically synthesized
caagacgcaggaggcagaa

SEQ ID NO: 16504 - RNA, 19 nt, artificial
  Chemically synthesized
ccagcaacuuggaaaucag

SEQ ID NO: 16505 - RNA, 19 nt, artificial
  Chemically synthesized
cuuucuguagaagauacca

SEQ ID NO: 16506 - RNA, 19 nt, artificial
  Chemically synthesized
agccagcagccuuuccaca

SEQ ID NO: 16507 - RNA, 19 nt, artificial
  Chemically synthesized
ugcccuguggacaguggaa

SEQ ID NO: 16508 - RNA, 19 nt, artificial
  Chemically synthesized
gccugcaggacgccauaga

SEQ ID NO: 16509 - RNA, 19 nt, artificial
  Chemically synthesized
gcuggugcggcuggacgaa

SEQ ID NO: 16510 - RNA, 19 nt, artificial
  Chemically synthesized
gcaguguggaacaugccuu

SEQ ID NO: 16511 - RNA, 19 nt, artificial
  Chemically synthesized
ccuccaacuucgacugucg

SEQ ID NO: 16512 - RNA, 19 nt, artificial
  Chemically synthesized
ugagcaaccucacgcgaca

SEQ ID NO: 16513 - RNA, 19 nt, artificial
  Chemically synthesized
gccagggcagacgaacaca

SEQ ID NO: 16514 - RNA, 19 nt, artificial
  Chemically synthesized
ccagcaccaacuacccagu

SEQ ID NO: 16515 - RNA, 19 nt, artificial
  Chemically synthesized
ccuccugcaugccaugguu

SEQ ID NO: 16516 - RNA, 19 nt, artificial
  Chemically synthesized
cuacuucucaccuccaacu

SEQ ID NO: 16517 - RNA, 19 nt, artificial
  Chemically synthesized
gcuacggucuuuuaauuau

SEQ ID NO: 16518 - RNA, 19 nt, artificial
  Chemically synthesized
cagaaaccagcaccaacua

SEQ ID NO: 16519 - RNA, 19 nt, artificial
  Chemically synthesized
ccacaugucauuugggacu

SEQ ID NO: 16520 - RNA, 19 nt, artificial
  Chemically synthesized
ccaggagccugaggagaug

SEQ ID NO: 16521 - RNA, 19 nt, artificial
  Chemically synthesized
uucuggagccggucaaaaa

SEQ ID NO: 16522 - RNA, 19 nt, artificial
  Chemically synthesized
gcuuuugggagccacaugu

SEQ ID NO: 16523 - RNA, 19 nt, artificial
  Chemically synthesized
cucucuagaggcauugaag

SEQ ID NO: 16524 - RNA, 19 nt, artificial
  Chemically synthesized
cccugcgggaacagagcca

SEQ ID NO: 16525 - RNA, 19 nt, artificial
  Chemically synthesized
ggacaagacgcaggaggca

SEQ ID NO: 16526 - RNA, 19 nt, artificial
  Chemically synthesized
agaaugaccgcguguccuu

SEQ ID NO: 16527 - RNA, 19 nt, artificial
  Chemically synthesized
gaagccguccgcacccuca

SEQ ID NO: 16528 - RNA, 19 nt, artificial
  Chemically synthesized
uacaauuccaaucucucua

SEQ ID NO: 16529 - RNA, 19 nt, artificial
  Chemically synthesized
uccuacuucucaccuccaa

SEQ ID NO: 16530 - RNA, 19 nt, artificial
  Chemically synthesized
uggaaucaucaucggaaca

SEQ ID NO: 16531 - RNA, 19 nt, artificial
  Chemically synthesized
ccggacgcuccaguccaau

SEQ ID NO: 16532 - RNA, 19 nt, artificial
  Chemically synthesized
gcguguccuugccugacca

SEQ ID NO: 16533 - RNA, 19 nt, artificial
  Chemically synthesized
agaacuggauacgguguuu

SEQ ID NO: 16534 - RNA, 19 nt, artificial
  Chemically synthesized
ggugcagcaggccaggaca

SEQ ID NO: 16535 - RNA, 19 nt, artificial
  Chemically synthesized
gacaaaacgggcgcgauga

SEQ ID NO: 16536 - RNA, 19 nt, artificial
  Chemically synthesized
accaggugaaccaagccau

SEQ ID NO: 16537 - RNA, 19 nt, artificial
  Chemically synthesized
cgccuucgacauucuaggu

SEQ ID NO: 16538 - RNA, 19 nt, artificial
  Chemically synthesized
gggagccacaugucauuug

SEQ ID NO: 16539 - RNA, 19 nt, artificial
  Chemically synthesized
ggaaccagagaggguccca

SEQ ID NO: 16540 - RNA, 19 nt, artificial
  Chemically synthesized
ccuacucagccuaccucca

SEQ ID NO: 16541 - RNA, 19 nt, artificial
  Chemically synthesized
agcuuucaucauccuacuu

SEQ ID NO: 16542 - RNA, 19 nt, artificial
  Chemically synthesized
ggucgccagacugugucau

SEQ ID NO: 16543 - RNA, 19 nt, artificial
  Chemically synthesized
ggagccacaugucauuugg

SEQ ID NO: 16544 - RNA, 19 nt, artificial
  Chemically synthesized
ccuucaccaccuccagcuu

SEQ ID NO: 16545 - RNA, 19 nt, artificial
  Chemically synthesized
ggaggcagaaugaccgcgu

SEQ ID NO: 16546 - RNA, 19 nt, artificial
  Chemically synthesized
cuauucuggagccggucaa

SEQ ID NO: 16547 - RNA, 19 nt, artificial
  Chemically synthesized
aggccaggaucucucuaga

SEQ ID NO: 16548 - RNA, 19 nt, artificial
  Chemically synthesized
ccaccacgcacagauggua

SEQ ID NO: 16549 - RNA, 19 nt, artificial
  Chemically synthesized
auuccaaucucucuauuuc

SEQ ID NO: 16550 - RNA, 19 nt, artificial
  Chemically synthesized
uuccaaucucucuauuucu

SEQ ID NO: 16551 - RNA, 19 nt, artificial
  Chemically synthesized
acaagacgcaggaggcaga

SEQ ID NO: 16552 - RNA, 19 nt, artificial
  Chemically synthesized
cccagaugcaaccuccacu

SEQ ID NO: 16553 - RNA, 19 nt, artificial
  Chemically synthesized
gaacaugccuucaccaccu

SEQ ID NO: 16554 - RNA, 19 nt, artificial
  Chemically synthesized
cagcccaccuccugggcuu

SEQ ID NO: 16555 - RNA, 19 nt, artificial
  Chemically synthesized
gcuccagaaaccagcacca

SEQ ID NO: 16556 - RNA, 19 nt, artificial
  Chemically synthesized
ggaugcaggcggcggcacu

SEQ ID NO: 16557 - RNA, 19 nt, artificial
  Chemically synthesized
ccauugacgguguuucgga

SEQ ID NO: 16558 - RNA, 19 nt, artificial
  Chemically synthesized
cccaggcgcccgaggacaa

SEQ ID NO: 16559 - RNA, 19 nt, artificial
  Chemically synthesized
cgcgggcaacuccgcagaa

SEQ ID NO: 16560 - RNA, 19 nt, artificial
  Chemically synthesized
gccaacaccuggacgguga

SEQ ID NO: 16561 - RNA, 19 nt, artificial
  Chemically synthesized
ccgggagcccuucauuuag

SEQ ID NO: 16562 - RNA, 19 nt, artificial
  Chemically synthesized
gcgccuucgacauucuagg

SEQ ID NO: 16563 - RNA, 19 nt, artificial
  Chemically synthesized
ggcagaaugaccgcguguc

SEQ ID NO: 16564 - RNA, 19 nt, artificial
  Chemically synthesized
gcccagcucagcuccgaca

SEQ ID NO: 16565 - RNA, 19 nt, artificial
  Chemically synthesized
caggugaaccaagccauga

SEQ ID NO: 16566 - RNA, 19 nt, artificial
  Chemically synthesized
gagaugagcuggccgccau

SEQ ID NO: 16567 - RNA, 19 nt, artificial
  Chemically synthesized
aagauaccaccucuccaaa

SEQ ID NO: 16568 - RNA, 19 nt, artificial
  Chemically synthesized
cgcccgaggacaagacgca

SEQ ID NO: 16569 - RNA, 19 nt, artificial
  Chemically synthesized
gcccgaaaggccaugugga

SEQ ID NO: 16570 - RNA, 19 nt, artificial
  Chemically synthesized
uggauacgguguuuacaau

SEQ ID NO: 16571 - RNA, 19 nt, artificial
  Chemically synthesized
ccuaccaggcacagaugga

SEQ ID NO: 16572 - RNA, 19 nt, artificial
  Chemically synthesized
ccuuccucccuggaaucau

SEQ ID NO: 16573 - RNA, 19 nt, artificial
  Chemically synthesized
cagcagccuuuccacaguc

SEQ ID NO: 16574 - RNA, 19 nt, artificial
  Chemically synthesized
gaggcagaaugaccgcgug

SEQ ID NO: 16575 - RNA, 19 nt, artificial
  Chemically synthesized
ggagaagcuggaggcccuu

SEQ ID NO: 16576 - RNA, 19 nt, artificial
  Chemically synthesized
cugccacuuucaggacauu

SEQ ID NO: 16577 - RNA, 19 nt, artificial
  Chemically synthesized
gaaggaacaggacacccga

SEQ ID NO: 16578 - RNA, 19 nt, artificial
  Chemically synthesized
acuuguccuaccaggcaca

SEQ ID NO: 16579 - RNA, 19 nt, artificial
  Chemically synthesized
ccaggacaagcucuuguau

SEQ ID NO: 16580 - RNA, 19 nt, artificial
  Chemically synthesized
cuuccucccuggaaucauc

SEQ ID NO: 16581 - RNA, 19 nt, artificial
  Chemically synthesized
ccuguggacaguggaagau

SEQ ID NO: 16582 - RNA, 19 nt, artificial
  Chemically synthesized
agacgccacuccaacuuuc

SEQ ID NO: 16583 - RNA, 19 nt, artificial
  Chemically synthesized
cccuccucccuguucccuu

SEQ ID NO: 16584 - RNA, 19 nt, artificial
  Chemically synthesized
ccuucgacauucuaggugc

SEQ ID NO: 16585 - RNA, 19 nt, artificial
  Chemically synthesized
uccugcagaaccuggaaca

SEQ ID NO: 16586 - RNA, 19 nt, artificial
  Chemically synthesized
gggacguggccuaccagga

SEQ ID NO: 16587 - RNA, 19 nt, artificial
  Chemically synthesized
gggugcucccugcgaucca

SEQ ID NO: 16588 - RNA, 19 nt, artificial
  Chemically synthesized
cucagcuuucaucauccua

SEQ ID NO: 16589 - RNA, 19 nt, artificial
  Chemically synthesized
cgccauagaccacucagcu

SEQ ID NO: 16590 - RNA, 19 nt, artificial
  Chemically synthesized
gguguuucggacuggagcc

SEQ ID NO: 16591 - RNA, 19 nt, artificial
  Chemically synthesized
ugcccuuccucagccugca

SEQ ID NO: 16592 - RNA, 19 nt, artificial
  Chemically synthesized
cacccgagcccugcgggaa

SEQ ID NO: 16593 - RNA, 19 nt, artificial
  Chemically synthesized
agcuccugcagaaccugga

SEQ ID NO: 16594 - RNA, 19 nt, artificial
  Chemically synthesized
cugccugcaggacgccaua

SEQ ID NO: 16595 - RNA, 19 nt, artificial
  Chemically synthesized
uguuucggacuggagccaa

SEQ ID NO: 16596 - RNA, 19 nt, artificial
  Chemically synthesized
cauagaccacucagcuuuc

SEQ ID NO: 16597 - RNA, 19 nt, artificial
  Chemically synthesized
cuggacgaacacucccaga

SEQ ID NO: 16598 - RNA, 19 nt, artificial
  Chemically synthesized
aacuuucuguagaagauac

SEQ ID NO: 16599 - RNA, 19 nt, artificial
  Chemically synthesized
gcagcuccagguggcuuuu

SEQ ID NO: 16600 - RNA, 19 nt, artificial
  Chemically synthesized
aaugccucuagagagaucc

SEQ ID NO: 16601 - RNA, 19 nt, artificial
  Chemically synthesized
uuauagaauuucuguuccg

SEQ ID NO: 16602 - RNA, 19 nt, artificial
  Chemically synthesized
uucacccagaaauagagag

SEQ ID NO: 16603 - RNA, 19 nt, artificial
  Chemically synthesized
uuguccuaaaugaagggcu

SEQ ID NO: 16604 - RNA, 19 nt, artificial
  Chemically synthesized
uauccaguucugaccaccc

SEQ ID NO: 16605 - RNA, 19 nt, artificial
  Chemically synthesized
uagaauuucuguuccgaug

SEQ ID NO: 16606 - RNA, 19 nt, artificial
  Chemically synthesized
aucuucuacagaaaguugg

SEQ ID NO: 16607 - RNA, 19 nt, artificial
  Chemically synthesized
uuccgaugaugauuccagg

SEQ ID NO: 16608 - RNA, 19 nt, artificial
  Chemically synthesized
uacccauucacuguuccag

SEQ ID NO: 16609 - RNA, 19 nt, artificial
  Chemically synthesized
ugacacagucuggcgaccc

SEQ ID NO: 16610 - RNA, 19 nt, artificial
  Chemically synthesized
ucuuccacuguccacaggg

SEQ ID NO: 16611 - RNA, 19 nt, artificial
  Chemically synthesized
ucuguuccgaugaugauuc

SEQ ID NO: 16612 - RNA, 19 nt, artificial
  Chemically synthesized
agaaguaggaugaugaaag

SEQ ID NO: 16613 - RNA, 19 nt, artificial
  Chemically synthesized
uauuuggagaggugguauc

SEQ ID NO: 16614 - RNA, 19 nt, artificial
  Chemically synthesized
aaagaccguagcaauaccc

SEQ ID NO: 16615 - RNA, 19 nt, artificial
  Chemically synthesized
ucaucuuccacuguccaca

SEQ ID NO: 16616 - RNA, 19 nt, artificial
  Chemically synthesized
ucacuguuccagguucugc

SEQ ID NO: 16617 - RNA, 19 nt, artificial
  Chemically synthesized
uuggagaggugguaucuuc

SEQ ID NO: 16618 - RNA, 19 nt, artificial
  Chemically synthesized
uagcucuggagguaggcug

SEQ ID NO: 16619 - RNA, 19 nt, artificial
  Chemically synthesized
aaagcugaguggucuaugg

SEQ ID NO: 16620 - RNA, 19 nt, artificial
  Chemically synthesized
uucugcacgcccagugucc

SEQ ID NO: 16621 - RNA, 19 nt, artificial
  Chemically synthesized
uuuuguccuaaaugaaggg

SEQ ID NO: 16622 - RNA, 19 nt, artificial
  Chemically synthesized
aauuucuguuccgaugaug

SEQ ID NO: 16623 - RNA, 19 nt, artificial
  Chemically synthesized
acuguggaaaggcugcugg

SEQ ID NO: 16624 - RNA, 19 nt, artificial
  Chemically synthesized
agugacuguggaaaggcug

SEQ ID NO: 16625 - RNA, 19 nt, artificial
  Chemically synthesized
uggucuuugacagagcagg

SEQ ID NO: 16626 - RNA, 19 nt, artificial
  Chemically synthesized
accaccaagacccuucacc

SEQ ID NO: 16627 - RNA, 19 nt, artificial
  Chemically synthesized
uucucccgaacccgcaggg

SEQ ID NO: 16628 - RNA, 19 nt, artificial
  Chemically synthesized
aaaggcugcuggcuguggg

SEQ ID NO: 16629 - RNA, 19 nt, artificial
  Chemically synthesized
ugggaguguucguccagcc

SEQ ID NO: 16630 - RNA, 19 nt, artificial
  Chemically synthesized
uguuccuuccuccacaugg

SEQ ID NO: 16631 - RNA, 19 nt, artificial
  Chemically synthesized
uaucuucuacagaaaguug

SEQ ID NO: 16632 - RNA, 19 nt, artificial
  Chemically synthesized
uugguauuuggagaggugg

SEQ ID NO: 16633 - RNA, 19 nt, artificial
  Chemically synthesized
auagaauuucuguuccgau

SEQ ID NO: 16634 - RNA, 19 nt, artificial
  Chemically synthesized
aucuccucaggcuccuggc

SEQ ID NO: 16635 - RNA, 19 nt, artificial
  Chemically synthesized
uuuguccuaaaugaagggc

SEQ ID NO: 16636 - RNA, 19 nt, artificial
  Chemically synthesized
uauagaauuucuguuccga

SEQ ID NO: 16637 - RNA, 19 nt, artificial
  Chemically synthesized
uuccuggcgaagaucuggg

SEQ ID NO: 16638 - RNA, 19 nt, artificial
  Chemically synthesized
uccacuggguaguuggugc

SEQ ID NO: 16639 - RNA, 19 nt, artificial
  Chemically synthesized
auuggaauuguaaacaccg

SEQ ID NO: 16640 - RNA, 19 nt, artificial
  Chemically synthesized
agggccuccagcuucuccc

SEQ ID NO: 16641 - RNA, 19 nt, artificial
  Chemically synthesized
auucacuguuccagguucu

SEQ ID NO: 16642 - RNA, 19 nt, artificial
  Chemically synthesized
aagcagaucagggauccgg

SEQ ID NO: 16643 - RNA, 19 nt, artificial
  Chemically synthesized
uccagcuucucccgaaccc

SEQ ID NO: 16644 - RNA, 19 nt, artificial
  Chemically synthesized
aauuguaaacaccguaucc

SEQ ID NO: 16645 - RNA, 19 nt, artificial
  Chemically synthesized
ugacuguggaaaggcugcu

SEQ ID NO: 16646 - RNA, 19 nt, artificial
  Chemically synthesized
ucguccagccgcaccagcc

SEQ ID NO: 16647 - RNA, 19 nt, artificial
  Chemically synthesized
aaauccucgcagaaggugg

SEQ ID NO: 16648 - RNA, 19 nt, artificial
  Chemically synthesized
uuggacuggagcguccgga

SEQ ID NO: 16649 - RNA, 19 nt, artificial
  Chemically synthesized
ugcugcaccuagaaugucg

SEQ ID NO: 16650 - RNA, 19 nt, artificial
  Chemically synthesized
agaucugggaguguucguc

SEQ ID NO: 16651 - RNA, 19 nt, artificial
  Chemically synthesized
auuucuguuccgaugauga

SEQ ID NO: 16652 - RNA, 19 nt, artificial
  Chemically synthesized
ucauucugccuccugcguc

SEQ ID NO: 16653 - RNA, 19 nt, artificial
  Chemically synthesized
aagcugaguggucuauggc

SEQ ID NO: 16654 - RNA, 19 nt, artificial
  Chemically synthesized
ugcaccuagaaugucgaag

SEQ ID NO: 16655 - RNA, 19 nt, artificial
  Chemically synthesized
aucauggcuugguucaccu

SEQ ID NO: 16656 - RNA, 19 nt, artificial
  Chemically synthesized
aguaggaugaugaaagcug

SEQ ID NO: 16657 - RNA, 19 nt, artificial
  Chemically synthesized
cacaugugguuguucagcc

SEQ ID NO: 16658 - RNA, 19 nt, artificial
  Chemically synthesized
uucaguuugugcuucagau

SEQ ID NO: 16659 - RNA, 19 nt, artificial
  Chemically synthesized
acccauucacuguuccagg

SEQ ID NO: 16660 - RNA, 19 nt, artificial
  Chemically synthesized
ucagauacaagagcuuguc

SEQ ID NO: 16661 - RNA, 19 nt, artificial
  Chemically synthesized
ccuucacccagaaauagag

SEQ ID NO: 16662 - RNA, 19 nt, artificial
  Chemically synthesized
accuggugcaggcucaggc

SEQ ID NO: 16663 - RNA, 19 nt, artificial
  Chemically synthesized
uugugcuucagauacaaga

SEQ ID NO: 16664 - RNA, 19 nt, artificial
  Chemically synthesized
gauuggaauuguaaacacc

SEQ ID NO: 16665 - RNA, 19 nt, artificial
  Chemically synthesized
uccuaaaugaagggcuccc

SEQ ID NO: 16666 - RNA, 19 nt, artificial
  Chemically synthesized
uggugggcuggcaaucucc

SEQ ID NO: 16667 - RNA, 19 nt, artificial
  Chemically synthesized
uuccacaugugguuguuca

SEQ ID NO: 16668 - RNA, 19 nt, artificial
  Chemically synthesized
ucaggugagcugaacaagg

SEQ ID NO: 16669 - RNA, 19 nt, artificial
  Chemically synthesized
ugaaaguggcagaugaccu

SEQ ID NO: 16670 - RNA, 19 nt, artificial
  Chemically synthesized
aauagagagauuggaauug

SEQ ID NO: 16671 - RNA, 19 nt, artificial
  Chemically synthesized
ucgucacagagcuugcugg

SEQ ID NO: 16672 - RNA, 19 nt, artificial
  Chemically synthesized
uuccagguucugcaggagc

SEQ ID NO: 16673 - RNA, 19 nt, artificial
  Chemically synthesized
agauacaagagcuuguccu

SEQ ID NO: 16674 - RNA, 19 nt, artificial
  Chemically synthesized
ugagguugcucaucauggc

SEQ ID NO: 16675 - RNA, 19 nt, artificial
  Chemically synthesized
uacaagagcuuguccuggc

SEQ ID NO: 16676 - RNA, 19 nt, artificial
  Chemically synthesized
uucacuguuccagguucug

SEQ ID NO: 16677 - RNA, 19 nt, artificial
  Chemically synthesized
aaaugaagggcucccggac

SEQ ID NO: 16678 - RNA, 19 nt, artificial
  Chemically synthesized
ccaccaagacccuucaccc

SEQ ID NO: 16679 - RNA, 19 nt, artificial
  Chemically synthesized
uuugugcuucagauacaag

SEQ ID NO: 16680 - RNA, 19 nt, artificial
  Chemically synthesized
aagccgaggauggugggag

SEQ ID NO: 16681 - RNA, 19 nt, artificial
  Chemically synthesized
uucuguuccgaugaugauu

SEQ ID NO: 16682 - RNA, 19 nt, artificial
  Chemically synthesized
uaaaugaagggcucccgga

SEQ ID NO: 16683 - RNA, 19 nt, artificial
  Chemically synthesized
uccgaugaugauuccaggg

SEQ ID NO: 16684 - RNA, 19 nt, artificial
  Chemically synthesized
guuccgaugaugauuccag

SEQ ID NO: 16685 - RNA, 19 nt, artificial
  Chemically synthesized
acaugugguuguucagccc

SEQ ID NO: 16686 - RNA, 19 nt, artificial
  Chemically synthesized
guuauagaauuucuguucc

SEQ ID NO: 16687 - RNA, 19 nt, artificial
  Chemically synthesized
ugagggcgcuggcuccacc

SEQ ID NO: 16688 - RNA, 19 nt, artificial
  Chemically synthesized
acaauguccugaaaguggc

SEQ ID NO: 16689 - RNA, 19 nt, artificial
  Chemically synthesized
ugcuucagauacaagagcu

SEQ ID NO: 16690 - RNA, 19 nt, artificial
  Chemically synthesized
ugaguggucuauggcgucc

SEQ ID NO: 16691 - RNA, 19 nt, artificial
  Chemically synthesized
agagauuggaauuguaaac

SEQ ID NO: 16692 - RNA, 19 nt, artificial
  Chemically synthesized
uugcucaucauggcuuggu

SEQ ID NO: 16693 - RNA, 19 nt, artificial
  Chemically synthesized
agcuucaggagaaccaugg

SEQ ID NO: 16694 - RNA, 19 nt, artificial
  Chemically synthesized
cacuguuccagguucugca

SEQ ID NO: 16695 - RNA, 19 nt, artificial
  Chemically synthesized
ugugcuucagauacaagag

SEQ ID NO: 16696 - RNA, 19 nt, artificial
  Chemically synthesized
ugucgaaggcgcuaggaag

SEQ ID NO: 16697 - RNA, 19 nt, artificial
  Chemically synthesized
agguucugcaggagcugcc

SEQ ID NO: 16698 - RNA, 19 nt, artificial
  Chemically synthesized
aagguguuggccaccuucc

SEQ ID NO: 16699 - RNA, 19 nt, artificial
  Chemically synthesized
agcucaucuccucaggcuc

SEQ ID NO: 16700 - RNA, 19 nt, artificial
  Chemically synthesized
cacuccacuggguaguugg

SEQ ID NO: 16701 - RNA, 19 nt, artificial
  Chemically synthesized
ucugaccacccugaaagcc

SEQ ID NO: 16702 - RNA, 19 nt, artificial
  Chemically synthesized
agacccuucacccagaaau

SEQ ID NO: 16703 - RNA, 19 nt, artificial
  Chemically synthesized
aagugggaaaggguggcgg

SEQ ID NO: 16704 - RNA, 19 nt, artificial
  Chemically synthesized
uguucguccagccgcacca

SEQ ID NO: 16705 - RNA, 19 nt, artificial
  Chemically synthesized
uucuccucagccagcaggu

SEQ ID NO: 16706 - RNA, 19 nt, artificial
  Chemically synthesized
augaccucaucuuccacug

SEQ ID NO: 16707 - RNA, 19 nt, artificial
  Chemically synthesized
uugguucaccuggugcagg

SEQ ID NO: 16708 - RNA, 19 nt, artificial
  Chemically synthesized
accucaucuuccacugucc

SEQ ID NO: 16709 - RNA, 19 nt, artificial
  Chemically synthesized
ucucugguuccacaugugg

SEQ ID NO: 16710 - RNA, 19 nt, artificial
  Chemically synthesized
ugccucuagagagauccug

SEQ ID NO: 16711 - RNA, 19 nt, artificial
  Chemically synthesized
aguuggugcugguuucugg

SEQ ID NO: 16712 - RNA, 19 nt, artificial
  Chemically synthesized
ucaucuccucaggcuccug

SEQ ID NO: 16713 - RNA, 19 nt, artificial
  Chemically synthesized
uucaggagaaccauggcau

SEQ ID NO: 16714 - RNA, 19 nt, artificial
  Chemically synthesized
ucacccagaaauagagaga

SEQ ID NO: 16715 - RNA, 19 nt, artificial
  Chemically synthesized
uuccuuccuccacauggcc

SEQ ID NO: 16716 - RNA, 19 nt, artificial
  Chemically synthesized
ugguucaccuggugcaggc

SEQ ID NO: 16717 - RNA, 19 nt, artificial
  Chemically synthesized
uggagcguccggaugcucc

SEQ ID NO: 16718 - RNA, 19 nt, artificial
  Chemically synthesized
ugguaggacaaguagcucu

SEQ ID NO: 16719 - RNA, 19 nt, artificial
  Chemically synthesized
gaucugggaguguucgucc

SEQ ID NO: 16720 - RNA, 19 nt, artificial
  Chemically synthesized
aucgcagggagcacccuug

SEQ ID NO: 16721 - RNA, 19 nt, artificial
  Chemically synthesized
agaggugguaucuucuaca

SEQ ID NO: 16722 - RNA, 19 nt, artificial
  Chemically synthesized
guauccaguucugaccacc

SEQ ID NO: 16723 - RNA, 19 nt, artificial
  Chemically synthesized
uuggcucuguucccgcagg

SEQ ID NO: 16724 - RNA, 19 nt, artificial
  Chemically synthesized
uguccuaaaugaagggcuc

SEQ ID NO: 16725 - RNA, 19 nt, artificial
  Chemically synthesized
uucaccuggugcaggcuca

SEQ ID NO: 16726 - RNA, 19 nt, artificial
  Chemically synthesized
uuucuguuccgaugaugau

SEQ ID NO: 16727 - RNA, 19 nt, artificial
  Chemically synthesized
uccaguucugaccacccug

SEQ ID NO: 16728 - RNA, 19 nt, artificial
  Chemically synthesized
agauuggacuggagcgucc

SEQ ID NO: 16729 - RNA, 19 nt, artificial
  Chemically synthesized
uguucccgcagggcucggg

SEQ ID NO: 16730 - RNA, 19 nt, artificial
  Chemically synthesized
uuguaaacaccguauccag

SEQ ID NO: 16731 - RNA, 19 nt, artificial
  Chemically synthesized
auagagagauuggaauugu

SEQ ID NO: 16732 - RNA, 19 nt, artificial
  Chemically synthesized
cauguggcucccaaaagcc

SEQ ID NO: 16733 - RNA, 19 nt, artificial
  Chemically synthesized
uucgucugcccuggcgugg

SEQ ID NO: 16734 - RNA, 19 nt, artificial
  Chemically synthesized
ucuacagaaaguuggagug

SEQ ID NO: 16735 - RNA, 19 nt, artificial
  Chemically synthesized
auuuggagaggugguaucu

SEQ ID NO: 16736 - RNA, 19 nt, artificial
  Chemically synthesized
aggaucacaaaguuauaga

SEQ ID NO: 16737 - RNA, 19 nt, artificial
  Chemically synthesized
uucagauacaagagcuugu

SEQ ID NO: 16738 - RNA, 19 nt, artificial
  Chemically synthesized
guucugaccacccugaaag

SEQ ID NO: 16739 - RNA, 19 nt, artificial
  Chemically synthesized
uggcugauuuccaaguugc

SEQ ID NO: 16740 - RNA, 19 nt, artificial
  Chemically synthesized
uggagaggugguaucuucu

SEQ ID NO: 16741 - RNA, 19 nt, artificial
  Chemically synthesized
uucugaccacccugaaagc

SEQ ID NO: 16742 - RNA, 19 nt, artificial
  Chemically synthesized
ucccaaaugacauguggcu

SEQ ID NO: 16743 - RNA, 19 nt, artificial
  Chemically synthesized
caucauggcuugguucacc

SEQ ID NO: 16744 - RNA, 19 nt, artificial
  Chemically synthesized
ucacagagcuugcugggcc

SEQ ID NO: 16745 - RNA, 19 nt, artificial
  Chemically synthesized
ugcgccacuggguccuggg

SEQ ID NO: 16746 - RNA, 19 nt, artificial
  Chemically synthesized
uggagcugcuccaucugug

SEQ ID NO: 16747 - RNA, 19 nt, artificial
  Chemically synthesized
uguucgucugcccuggcgu

SEQ ID NO: 16748 - RNA, 19 nt, artificial
  Chemically synthesized
agguguuggcucuguuccc

SEQ ID NO: 16749 - RNA, 19 nt, artificial
  Chemically synthesized
ugauuuccaaguugcuggc

SEQ ID NO: 16750 - RNA, 19 nt, artificial
  Chemically synthesized
aaagccaccuggagcugcu

SEQ ID NO: 16751 - RNA, 19 nt, artificial
  Chemically synthesized
guaggcugcguucagugcc

SEQ ID NO: 16752 - RNA, 19 nt, artificial
  Chemically synthesized
uggaggaucacaaaguuau

SEQ ID NO: 16753 - RNA, 19 nt, artificial
  Chemically synthesized
accguauccaguucugacc

SEQ ID NO: 16754 - RNA, 19 nt, artificial
  Chemically synthesized
aaagccagggcaucaucgc

SEQ ID NO: 16755 - RNA, 19 nt, artificial
  Chemically synthesized
uuccugguaggccacgucc

SEQ ID NO: 16756 - RNA, 19 nt, artificial
  Chemically synthesized
guuuuguccuaaaugaagg

SEQ ID NO: 16757 - RNA, 19 nt, artificial
  Chemically synthesized
cacccuuggcuccaguccg

SEQ ID NO: 16758 - RNA, 19 nt, artificial
  Chemically synthesized
cuuggcuccaguccgaaac

SEQ ID NO: 16759 - RNA, 19 nt, artificial
  Chemically synthesized
agaaugucgaaggcgcuag

SEQ ID NO: 16760 - RNA, 19 nt, artificial
  Chemically synthesized
uaggcugcguucagugccg

SEQ ID NO: 16761 - RNA, 19 nt, artificial
  Chemically synthesized
uggucuauggcguccugca

SEQ ID NO: 16762 - RNA, 19 nt, artificial
  Chemically synthesized
guguccuguuccuuccucc

SEQ ID NO: 16763 - RNA, 19 nt, artificial
  Chemically synthesized
ucaucauggcuugguucac

SEQ ID NO: 16764 - RNA, 19 nt, artificial
  Chemically synthesized
ugaugaaagcugagugguc

SEQ ID NO: 16765 - RNA, 19 nt, artificial
  Chemically synthesized
uguggcucccaaaagccac

SEQ ID NO: 16766 - RNA, 19 nt, artificial
  Chemically synthesized
acagcuucuccucagccag

SEQ ID NO: 16767 - RNA, 19 nt, artificial
  Chemically synthesized
ucugcacgcccaguguccc

SEQ ID NO: 16768 - RNA, 19 nt, artificial
  Chemically synthesized
aaguuggaguggcgucugg

SEQ ID NO: 16769 - RNA, 19 nt, artificial
  Chemically synthesized
agauuggaauuguaaacac

SEQ ID NO: 16770 - RNA, 19 nt, artificial
  Chemically synthesized
uucugccuccugcgucuug

SEQ ID NO: 16771 - RNA, 19 nt, artificial
  Chemically synthesized
cugauuuccaaguugcugg

SEQ ID NO: 16772 - RNA, 19 nt, artificial
  Chemically synthesized
ugguaucuucuacagaaag

SEQ ID NO: 16773 - RNA, 19 nt, artificial
  Chemically synthesized
uguggaaaggcugcuggcu

SEQ ID NO: 16774 - RNA, 19 nt, artificial
  Chemically synthesized
uuccacuguccacagggca

SEQ ID NO: 16775 - RNA, 19 nt, artificial
  Chemically synthesized
ucuauggcguccugcaggc

SEQ ID NO: 16776 - RNA, 19 nt, artificial
  Chemically synthesized
uucguccagccgcaccagc

SEQ ID NO: 16777 - RNA, 19 nt, artificial
  Chemically synthesized
aaggcauguuccacacugc

SEQ ID NO: 16778 - RNA, 19 nt, artificial
  Chemically synthesized
cgacagucgaaguuggagg

SEQ ID NO: 16779 - RNA, 19 nt, artificial
  Chemically synthesized
ugucgcgugagguugcuca

SEQ ID NO: 16780 - RNA, 19 nt, artificial
  Chemically synthesized
uguguucgucugcccuggc

SEQ ID NO: 16781 - RNA, 19 nt, artificial
  Chemically synthesized
acuggguaguuggugcugg

SEQ ID NO: 16782 - RNA, 19 nt, artificial
  Chemically synthesized
aaccauggcaugcaggagg

SEQ ID NO: 16783 - RNA, 19 nt, artificial
  Chemically synthesized
aguuggaggugagaaguag

SEQ ID NO: 16784 - RNA, 19 nt, artificial
  Chemically synthesized
auaauuaaaagaccguagc

SEQ ID NO: 16785 - RNA, 19 nt, artificial
  Chemically synthesized
uaguuggugcugguuucug

SEQ ID NO: 16786 - RNA, 19 nt, artificial
  Chemically synthesized
agucccaaaugacaugugg

SEQ ID NO: 16787 - RNA, 19 nt, artificial
  Chemically synthesized
caucuccucaggcuccugg

SEQ ID NO: 16788 - RNA, 19 nt, artificial
  Chemically synthesized
uuuuugaccggcuccagaa

SEQ ID NO: 16789 - RNA, 19 nt, artificial
  Chemically synthesized
acauguggcucccaaaagc

SEQ ID NO: 16790 - RNA, 19 nt, artificial
  Chemically synthesized
cuucaaugccucuagagag

SEQ ID NO: 16791 - RNA, 19 nt, artificial
  Chemically synthesized
uggcucuguucccgcaggg

SEQ ID NO: 16792 - RNA, 19 nt, artificial
  Chemically synthesized
ugccuccugcgucuugucc

SEQ ID NO: 16793 - RNA, 19 nt, artificial
  Chemically synthesized
aaggacacgcggucauucu

SEQ ID NO: 16794 - RNA, 19 nt, artificial
  Chemically synthesized
ugagggugcggacggcuuc

SEQ ID NO: 16795 - RNA, 19 nt, artificial
  Chemically synthesized
uagagagauuggaauugua

SEQ ID NO: 16796 - RNA, 19 nt, artificial
  Chemically synthesized
uuggaggugagaaguagga

SEQ ID NO: 16797 - RNA, 19 nt, artificial
  Chemically synthesized
uguuccgaugaugauucca

SEQ ID NO: 16798 - RNA, 19 nt, artificial
  Chemically synthesized
auuggacuggagcguccgg

SEQ ID NO: 16799 - RNA, 19 nt, artificial
  Chemically synthesized
uggucaggcaaggacacgc

SEQ ID NO: 16800 - RNA, 19 nt, artificial
  Chemically synthesized
aaacaccguauccaguucu

SEQ ID NO: 16801 - RNA, 19 nt, artificial
  Chemically synthesized
uguccuggccugcugcacc

SEQ ID NO: 16802 - RNA, 19 nt, artificial
  Chemically synthesized
ucaucgcgcccguuuuguc

SEQ ID NO: 16803 - RNA, 19 nt, artificial
  Chemically synthesized
auggcuugguucaccuggu

SEQ ID NO: 16804 - RNA, 19 nt, artificial
  Chemically synthesized
accuagaaugucgaaggcg

SEQ ID NO: 16805 - RNA, 19 nt, artificial
  Chemically synthesized
caaaugacauguggcuccc

SEQ ID NO: 16806 - RNA, 19 nt, artificial
  Chemically synthesized
ugggacccucucugguucc

SEQ ID NO: 16807 - RNA, 19 nt, artificial
  Chemically synthesized
uggagguaggcugaguagg

SEQ ID NO: 16808 - RNA, 19 nt, artificial
  Chemically synthesized
aaguaggaugaugaaagcu

SEQ ID NO: 16809 - RNA, 19 nt, artificial
  Chemically synthesized
augacacagucuggcgacc

SEQ ID NO: 16810 - RNA, 19 nt, artificial
  Chemically synthesized
ccaaaugacauguggcucc

SEQ ID NO: 16811 - RNA, 19 nt, artificial
  Chemically synthesized
aagcuggagguggugaagg

SEQ ID NO: 16812 - RNA, 19 nt, artificial
  Chemically synthesized
acgcggucauucugccucc

SEQ ID NO: 16813 - RNA, 19 nt, artificial
  Chemically synthesized
uugaccggcuccagaauag

SEQ ID NO: 16814 - RNA, 19 nt, artificial
  Chemically synthesized
ucuagagagauccuggccu

SEQ ID NO: 16815 - RNA, 19 nt, artificial
  Chemically synthesized
uaccaucugugcguggugg

SEQ ID NO: 16816 - RNA, 19 nt, artificial
  Chemically synthesized
gaaauagagagauuggaau

SEQ ID NO: 16817 - RNA, 19 nt, artificial
  Chemically synthesized
agaaauagagagauuggaa

SEQ ID NO: 16818 - RNA, 19 nt, artificial
  Chemically synthesized
ucugccuccugcgucuugu

SEQ ID NO: 16819 - RNA, 19 nt, artificial
  Chemically synthesized
aguggagguugcaucuggg

SEQ ID NO: 16820 - RNA, 19 nt, artificial
  Chemically synthesized
agguggugaaggcauguuc

SEQ ID NO: 16821 - RNA, 19 nt, artificial
  Chemically synthesized
aagcccaggaggugggcug

SEQ ID NO: 16822 - RNA, 19 nt, artificial
  Chemically synthesized
uggugcugguuucuggagc

SEQ ID NO: 16823 - RNA, 19 nt, artificial
  Chemically synthesized
agugccgccgccugcaucc

SEQ ID NO: 16824 - RNA, 19 nt, artificial
  Chemically synthesized
uccgaaacaccgucaaugg

SEQ ID NO: 16825 - RNA, 19 nt, artificial
  Chemically synthesized
uuguccucgggcgccuggg

SEQ ID NO: 16826 - RNA, 19 nt, artificial
  Chemically synthesized
uucugcggaguugcccgcg

SEQ ID NO: 16827 - RNA, 19 nt, artificial
  Chemically synthesized
ucaccguccagguguuggc

SEQ ID NO: 16828 - RNA, 19 nt, artificial
  Chemically synthesized
cuaaaugaagggcucccgg

SEQ ID NO: 16829 - RNA, 19 nt, artificial
  Chemically synthesized
ccuagaaugucgaaggcgc

SEQ ID NO: 16830 - RNA, 19 nt, artificial
  Chemically synthesized
gacacgcggucauucugcc

SEQ ID NO: 16831 - RNA, 19 nt, artificial
  Chemically synthesized
ugucggagcugagcugggc

SEQ ID NO: 16832 - RNA, 19 nt, artificial
  Chemically synthesized
ucauggcuugguucaccug

SEQ ID NO: 16833 - RNA, 19 nt, artificial
  Chemically synthesized
auggcggccagcucaucuc

SEQ ID NO: 16834 - RNA, 19 nt, artificial
  Chemically synthesized
uuuggagaggugguaucuu

SEQ ID NO: 16835 - RNA, 19 nt, artificial
  Chemically synthesized
ugcgucuuguccucgggcg

SEQ ID NO: 16836 - RNA, 19 nt, artificial
  Chemically synthesized
uccacauggccuuucgggc

SEQ ID NO: 16837 - RNA, 19 nt, artificial
  Chemically synthesized
auuguaaacaccguaucca

SEQ ID NO: 16838 - RNA, 19 nt, artificial
  Chemically synthesized
uccaucugugccugguagg

SEQ ID NO: 16839 - RNA, 19 nt, artificial
  Chemically synthesized
augauuccagggaggaagg

SEQ ID NO: 16840 - RNA, 19 nt, artificial
  Chemically synthesized
gacuguggaaaggcugcug

SEQ ID NO: 16841 - RNA, 19 nt, artificial
  Chemically synthesized
cacgcggucauucugccuc

SEQ ID NO: 16842 - RNA, 19 nt, artificial
  Chemically synthesized
aagggccuccagcuucucc

SEQ ID NO: 16843 - RNA, 19 nt, artificial
  Chemically synthesized
aauguccugaaaguggcag

SEQ ID NO: 16844 - RNA, 19 nt, artificial
  Chemically synthesized
ucggguguccuguuccuuc

SEQ ID NO: 16845 - RNA, 19 nt, artificial
  Chemically synthesized
ugugccugguaggacaagu

SEQ ID NO: 16846 - RNA, 19 nt, artificial
  Chemically synthesized
auacaagagcuuguccugg

SEQ ID NO: 16847 - RNA, 19 nt, artificial
  Chemically synthesized
gaugauuccagggaggaag

SEQ ID NO: 16848 - RNA, 19 nt, artificial
  Chemically synthesized
aucuuccacuguccacagg

SEQ ID NO: 16849 - RNA, 19 nt, artificial
  Chemically synthesized
gaaaguuggaguggcgucu

SEQ ID NO: 16850 - RNA, 19 nt, artificial
  Chemically synthesized
aagggaacagggaggaggg

SEQ ID NO: 16851 - RNA, 19 nt, artificial
  Chemically synthesized
gcaccuagaaugucgaagg

SEQ ID NO: 16852 - RNA, 19 nt, artificial
  Chemically synthesized
uguuccagguucugcagga

SEQ ID NO: 16853 - RNA, 19 nt, artificial
  Chemically synthesized
uccugguaggccacguccc

SEQ ID NO: 16854 - RNA, 19 nt, artificial
  Chemically synthesized
uggaucgcagggagcaccc

SEQ ID NO: 16855 - RNA, 19 nt, artificial
  Chemically synthesized
uaggaugaugaaagcugag

SEQ ID NO: 16856 - RNA, 19 nt, artificial
  Chemically synthesized
agcugaguggucuauggcg

SEQ ID NO: 16857 - RNA, 19 nt, artificial
  Chemically synthesized
ggcuccaguccgaaacacc

SEQ ID NO: 16858 - RNA, 19 nt, artificial
  Chemically synthesized
ugcaggcugaggaagggca

SEQ ID NO: 16859 - RNA, 19 nt, artificial
  Chemically synthesized
uucccgcagggcucgggug

SEQ ID NO: 16860 - RNA, 19 nt, artificial
  Chemically synthesized
uccagguucugcaggagcu

SEQ ID NO: 16861 - RNA, 19 nt, artificial
  Chemically synthesized
uauggcguccugcaggcag

SEQ ID NO: 16862 - RNA, 19 nt, artificial
  Chemically synthesized
uuggcuccaguccgaaaca

SEQ ID NO: 16863 - RNA, 19 nt, artificial
  Chemically synthesized
gaaagcugaguggucuaug

SEQ ID NO: 16864 - RNA, 19 nt, artificial
  Chemically synthesized
ucugggaguguucguccag

SEQ ID NO: 16865 - RNA, 19 nt, artificial
  Chemically synthesized
guaucuucuacagaaaguu

SEQ ID NO: 16866 - RNA, 19 nt, Artificial Sequence
  Chemically synthesized
aaaagccaccuggagcugc

SEQ ID NO: 16867 - RNA, 19 nt, artificial
  Chemically synthesized
uguaccaccugcuggcuga

SEQ ID NO: 16868 - RNA, 19 nt, artificial
  Chemically synthesized
ccugcuggcugaggagaag

SEQ ID NO: 16869 - RNA, 19 nt, artificial
  Chemically synthesized
caccugcuggcugaggaga

SEQ ID NO: 16870 - RNA, 19 nt, artificial
  Chemically synthesized
accaccugcuggcugagga

SEQ ID NO: 16871 - RNA, 19 nt, artificial
  Chemically synthesized
ccaccugcuggcugaggag

SEQ ID NO: 16872 - RNA, 19 nt, artificial
  Chemically synthesized
guaccaccugcuggcugag

SEQ ID NO: 16873 - RNA, 19 nt, artificial
  Chemically synthesized
uuguaccaccugcuggcug

SEQ ID NO: 16874 - RNA, 19 nt, artificial
  Chemically synthesized
uaccaccugcuggcugagg

SEQ ID NO: 16875 - RNA, 19 nt, artificial
  Chemically synthesized
ucagccagcaggugguaca

SEQ ID NO: 16876 - RNA, 19 nt, artificial
  Chemically synthesized
cuucuccucagccagcagg

SEQ ID NO: 16877 - RNA, 19 nt, artificial
  Chemically synthesized
ucuccucagccagcaggug

SEQ ID NO: 16878 - RNA, 19 nt, artificial
  Chemically synthesized
uccucagccagcagguggu

SEQ ID NO: 16879 - RNA, 19 nt, artificial
  Chemically synthesized
cuccucagccagcaggugg

SEQ ID NO: 16880 - RNA, 19 nt, artificial
  Chemically synthesized
cucagccagcaggugguac

SEQ ID NO: 16881 - RNA, 19 nt, artificial
  Chemically synthesized
cagccagcaggugguacaa

SEQ ID NO: 16882 - RNA, 19 nt, Artificial Sequence
  Chemically synthesized
ccucagccagcagguggua

SEQ ID NO: 16883 - RNA, 18 nt, artificial
  Chemically synthesized
ggaucucucuagaggcau

SEQ ID NO: 16884 - RNA, 18 nt, artificial
  Chemically synthesized
gguguuuacaauuccaau

SEQ ID NO: 16885 - RNA, 18 nt, artificial
  Chemically synthesized
ggcugaacaaccacaugu

SEQ ID NO: 16886 - RNA, 18 nt, artificial
  Chemically synthesized
gggugaagggucuuggug

SEQ ID NO: 16887 - RNA, 18 nt, artificial
  Chemically synthesized
gguggucagaacuggaua

SEQ ID NO: 16888 - RNA, 18 nt, artificial
  Chemically synthesized
ccaacuuucuguagaaga

SEQ ID NO: 16889 - RNA, 18 nt, artificial
  Chemically synthesized
ugcagaaccuggaacagu

SEQ ID NO: 16890 - RNA, 18 nt, artificial
  Chemically synthesized
ccaacuacccaguggagu

SEQ ID NO: 16891 - RNA, 18 nt, artificial
  Chemically synthesized
cuggaaucaucaucggaa

SEQ ID NO: 16892 - RNA, 18 nt, artificial
  Chemically synthesized
ggacgaacacucccagau

SEQ ID NO: 16893 - RNA, 18 nt, artificial
  Chemically synthesized
ggcacugaacgcagccua

SEQ ID NO: 16894 - RNA, 18 nt, artificial
  Chemically synthesized
ccuucauuuaggacaaaa

SEQ ID NO: 16895 - RNA, 18 nt, artificial
  Chemically synthesized
ggaggaaggaacaggaca

SEQ ID NO: 16896 - RNA, 18 nt, artificial
  Chemically synthesized
cuuucaucauccuacuuc

SEQ ID NO: 16897 - RNA, 18 nt, artificial
  Chemically synthesized
gccaggagccugaggaga

SEQ ID NO: 16898 - RNA, 18 nt, artificial
  Chemically synthesized
guuucggacuggagccaa

SEQ ID NO: 16899 - RNA, 18 nt, artificial
  Chemically synthesized
cucuauuucugggugaag

SEQ ID NO: 16900 - RNA, 18 nt, artificial
  Chemically synthesized
ggcuuuugggagccacau

SEQ ID NO: 16901 - RNA, 18 nt, artificial
  Chemically synthesized
ccagcaacuuggaaauca

SEQ ID NO: 16902 - RNA, 18 nt, artificial
  Chemically synthesized
ggugaaccaagccaugau

SEQ ID NO: 16903 - RNA, 18 nt, artificial
  Chemically synthesized
cggacuggagccaagggu

SEQ ID NO: 16904 - RNA, 18 nt, artificial
  Chemically synthesized
cuuucaggguggucagaa

SEQ ID NO: 16905 - RNA, 18 nt, artificial
  Chemically synthesized
ccaggagccugaggagau

SEQ ID NO: 16906 - RNA, 18 nt, artificial
  Chemically synthesized
ggguauugcuacggucuu

SEQ ID NO: 16907 - RNA, 18 nt, artificial
  Chemically synthesized
cagccuuuccacagucac

SEQ ID NO: 16908 - RNA, 18 nt, artificial
  Chemically synthesized
ccgggagcccuucauuua

SEQ ID NO: 16909 - RNA, 18 nt, artificial
  Chemically synthesized
aucggaacagaaauucua

SEQ ID NO: 16910 - RNA, 18 nt, artificial
  Chemically synthesized
ggagccacaugucauuug

SEQ ID NO: 16911 - RNA, 18 nt, artificial
  Chemically synthesized
ccauagaccacucagcuu

SEQ ID NO: 16912 - RNA, 18 nt, artificial
  Chemically synthesized
ggugaagggucuuggugg

SEQ ID NO: 16913 - RNA, 18 nt, artificial
  Chemically synthesized
ggcagaaugaccgcgugu

SEQ ID NO: 16914 - RNA, 18 nt, artificial
  Chemically synthesized
gggagccacaugucauuu

SEQ ID NO: 16915 - RNA, 18 nt, artificial
  Chemically synthesized
caucaucggaacagaaau

SEQ ID NO: 16916 - RNA, 18 nt, artificial
  Chemically synthesized
cagcagccuuuccacagu

SEQ ID NO: 16917 - RNA, 18 nt, artificial
  Chemically synthesized
gcgccuucgacauucuag

SEQ ID NO: 16918 - RNA, 18 nt, artificial
  Chemically synthesized
cgguguuuacaauuccaa

SEQ ID NO: 16919 - RNA, 18 nt, artificial
  Chemically synthesized
gcgggaacagagccaaca

SEQ ID NO: 16920 - RNA, 18 nt, artificial
  Chemically synthesized
ccuucgacauucuaggug

SEQ ID NO: 16921 - RNA, 18 nt, artificial
  Chemically synthesized
cuuccucccuggaaucau

SEQ ID NO: 16922 - RNA, 18 nt, artificial
  Chemically synthesized
ccuacuucucaccuccaa

SEQ ID NO: 16923 - RNA, 18 nt, artificial
  Chemically synthesized
agacgccacuccaacuuu

SEQ ID NO: 16924 - RNA, 18 nt, artificial
  Chemically synthesized
cucucuagaggcauugaa

SEQ ID NO: 16925 - RNA, 18 nt, artificial
  Chemically synthesized
cauagaccacucagcuuu

SEQ ID NO: 16926 - RNA, 18 nt, artificial
  Chemically synthesized
gcucugucaaagaccaga

SEQ ID NO: 16927 - RNA, 18 nt, artificial
  Chemically synthesized
cggacgcuccaguccaau

SEQ ID NO: 16928 - RNA, 18 nt, artificial
  Chemically synthesized
ccuccaacuucgacuguc

SEQ ID NO: 16929 - RNA, 18 nt, artificial
  Chemically synthesized
gggagaagcuggaggccc

SEQ ID NO: 16930 - RNA, 18 nt, artificial
  Chemically synthesized
gcagccuuuccacaguca

SEQ ID NO: 16931 - RNA, 18 nt, artificial
  Chemically synthesized
gaggcagaaugaccgcgu

SEQ ID NO: 16932 - RNA, 18 nt, artificial
  Chemically synthesized
cccacagccagcagccuu

SEQ ID NO: 16933 - RNA, 18 nt, artificial
  Chemically synthesized
ccuccucccuguucccuu

SEQ ID NO: 16934 - RNA, 18 nt, artificial
  Chemically synthesized
ccaugaugagcaaccuca

SEQ ID NO: 16935 - RNA, 18 nt, artificial
  Chemically synthesized
guagaagauaccaccucu

SEQ ID NO: 16936 - RNA, 18 nt, artificial
  Chemically synthesized
ggucagaacuggauacgg

SEQ ID NO: 16937 - RNA, 18 nt, artificial
  Chemically synthesized
ucaucaucggaacagaaa

SEQ ID NO: 16938 - RNA, 18 nt, artificial
  Chemically synthesized
gccggaggcugcacccac

SEQ ID NO: 16939 - RNA, 18 nt, artificial
  Chemically synthesized
agcacaaacugaagaccc

SEQ ID NO: 16940 - RNA, 18 nt, artificial
  Chemically synthesized
aggugaaccaagccauga

SEQ ID NO: 16941 - RNA, 18 nt, artificial
  Chemically synthesized
gccacaugucauuuggga

SEQ ID NO: 16942 - RNA, 18 nt, artificial
  Chemically synthesized
ggcaggaccuccugcaug

SEQ ID NO: 16943 - RNA, 18 nt, artificial
  Chemically synthesized
gcaggacgccauagacca

SEQ ID NO: 16944 - RNA, 18 nt, artificial
  Chemically synthesized
gacgaacacucccagauc

SEQ ID NO: 16945 - RNA, 18 nt, artificial
  Chemically synthesized
ggaacagagccaacaccu

SEQ ID NO: 16946 - RNA, 18 nt, artificial
  Chemically synthesized
ccaggugaaccaagccau

SEQ ID NO: 16947 - RNA, 18 nt, artificial
  Chemically synthesized
ccaguggagugcaccgag

SEQ ID NO: 16948 - RNA, 18 nt, artificial
  Chemically synthesized
gaaccuggaacagugaau

SEQ ID NO: 16949 - RNA, 18 nt, artificial
  Chemically synthesized
agaccacucagcuuucau

SEQ ID NO: 16950 - RNA, 18 nt, artificial
  Chemically synthesized
cacauguggaaccagaga

SEQ ID NO: 16951 - RNA, 18 nt, artificial
  Chemically synthesized
ccggaucccugaucugcu

SEQ ID NO: 16952 - RNA, 18 nt, artificial
  Chemically synthesized
cagcuuucaucauccuac

SEQ ID NO: 16953 - RNA, 18 nt, artificial
  Chemically synthesized
gccuuuccacagucacug

SEQ ID NO: 16954 - RNA, 18 nt, artificial
  Chemically synthesized
ucaucauccuacuucuca

SEQ ID NO: 16955 - RNA, 18 nt, artificial
  Chemically synthesized
gacgcuccaguccaaucu

SEQ ID NO: 16956 - RNA, 18 nt, artificial
  Chemically synthesized
cccaguggagugcaccga

SEQ ID NO: 16957 - RNA, 18 nt, artificial
  Chemically synthesized
ggaccuccugcaugccau

SEQ ID NO: 16958 - RNA, 18 nt, artificial
  Chemically synthesized
ggauacgguguuuacaau

SEQ ID NO: 16959 - RNA, 18 nt, artificial
  Chemically synthesized
cuccaaauaccaagccgu

SEQ ID NO: 16960 - RNA, 18 nt, artificial
  Chemically synthesized
gaaccaagccaugaugag

SEQ ID NO: 16961 - RNA, 18 nt, artificial
  Chemically synthesized
ggagccugaggagaugag

SEQ ID NO: 16962 - RNA, 18 nt, artificial
  Chemically synthesized
gguguuucggacuggagc

SEQ ID NO: 16963 - RNA, 18 nt, artificial
  Chemically synthesized
gccauguggaggaaggaa

SEQ ID NO: 16964 - RNA, 18 nt, artificial
  Chemically synthesized
gagcccugcgggaacaga

SEQ ID NO: 16965 - RNA, 18 nt, artificial
  Chemically synthesized
agaaccuggaacagugaa

SEQ ID NO: 16966 - RNA, 18 nt, artificial
  Chemically synthesized
gcggguucgggagaagcu

SEQ ID NO: 16967 - RNA, 18 nt, artificial
  Chemically synthesized
ccaccuucugcgaggauu

SEQ ID NO: 16968 - RNA, 18 nt, artificial
  Chemically synthesized
ccagcagccuuuccacag

SEQ ID NO: 16969 - RNA, 18 nt, artificial
  Chemically synthesized
gucgccagacugugucau

SEQ ID NO: 16970 - RNA, 18 nt, artificial
  Chemically synthesized
cacucagcuuucaucauc

SEQ ID NO: 16971 - RNA, 18 nt, artificial
  Chemically synthesized
ggacaaaacgggcgcgau

SEQ ID NO: 16972 - RNA, 18 nt, artificial
  Chemically synthesized
caaucucucuauuucugg

SEQ ID NO: 16973 - RNA, 18 nt, artificial
  Chemically synthesized
agcgccuucgacauucua

SEQ ID NO: 16974 - RNA, 18 nt, artificial
  Chemically synthesized
gggcagacgaacacaucg

SEQ ID NO: 16975 - RNA, 18 nt, artificial
  Chemically synthesized
cccugaucugcuugggca

SEQ ID NO: 16976 - RNA, 18 nt, artificial
  Chemically synthesized
ggacaagcucuuguaucu

SEQ ID NO: 16977 - RNA, 18 nt, artificial
  Chemically synthesized
aggacaagcucuuguauc

SEQ ID NO: 16978 - RNA, 18 nt, artificial
  Chemically synthesized
gccauagaccacucagcu

SEQ ID NO: 16979 - RNA, 18 nt, artificial
  Chemically synthesized
agccuuuccacagucacu

SEQ ID NO: 16980 - RNA, 18 nt, artificial
  Chemically synthesized
ggacuggagccaagggug

SEQ ID NO: 16981 - RNA, 18 nt, artificial
  Chemically synthesized
ccacucagcuuucaucau

SEQ ID NO: 16982 - RNA, 18 nt, artificial
  Chemically synthesized
agacgcaggaggcagaau

SEQ ID NO: 16983 - RNA, 18 nt, artificial
  Chemically synthesized
ggguggagccagcgcccu

SEQ ID NO: 16984 - RNA, 18 nt, artificial
  Chemically synthesized
caccucuccaaauaccaa

SEQ ID NO: 16985 - RNA, 18 nt, artificial
  Chemically synthesized
cacugaacgcagccuacu

SEQ ID NO: 16986 - RNA, 18 nt, artificial
  Chemically synthesized
cuucucaccuccaacuuc

SEQ ID NO: 16987 - RNA, 18 nt, artificial
  Chemically synthesized
ggccaggaucucucuaga

SEQ ID NO: 16988 - RNA, 18 nt, artificial
  Chemically synthesized
ccugcaggacgccauaga

SEQ ID NO: 16989 - RNA, 18 nt, artificial
  Chemically synthesized
uccaaucucucuauuucu

SEQ ID NO: 16990 - RNA, 18 nt, artificial
  Chemically synthesized
gaccagacgccacuccaa

SEQ ID NO: 16991 - RNA, 18 nt, artificial
  Chemically synthesized
gucaaagaccagacgcca

SEQ ID NO: 16992 - RNA, 18 nt, artificial
  Chemically synthesized
cugucaaagaccagacgc

SEQ ID NO: 16993 - RNA, 18 nt, artificial
  Chemically synthesized
gggcaguguggaacaugc

SEQ ID NO: 16994 - RNA, 18 nt, artificial
  Chemically synthesized
cggguucgggagaagcug

SEQ ID NO: 16995 - RNA, 18 nt, artificial
  Chemically synthesized
cauucuaggugcagcagg

SEQ ID NO: 16996 - RNA, 18 nt, artificial
  Chemically synthesized
ggaacagugaauggguag

SEQ ID NO: 16997 - RNA, 18 nt, artificial
  Chemically synthesized
caguguggaacaugccuu

SEQ ID NO: 16998 - RNA, 18 nt, artificial
  Chemically synthesized
gccagcagccuuuccaca

SEQ ID NO: 16999 - RNA, 18 nt, artificial
  Chemically synthesized
guuuacaauuccaaucuc

SEQ ID NO: 17000 - RNA, 18 nt, artificial
  Chemically synthesized
gggcugaacaaccacaug

SEQ ID NO: 17001 - RNA, 18 nt, artificial
  Chemically synthesized
ccaugguucuccugaagc

SEQ ID NO: 17002 - RNA, 18 nt, artificial
  Chemically synthesized
caguggaagaugagguca

SEQ ID NO: 17003 - RNA, 18 nt, artificial
  Chemically synthesized
cagccagcagccuuucca

SEQ ID NO: 17004 - RNA, 18 nt, artificial
  Chemically synthesized
ccugcuggcugaggagaa

SEQ ID NO: 17005 - RNA, 18 nt, artificial
  Chemically synthesized
gccacuuucaggacauug

SEQ ID NO: 17006 - RNA, 18 nt, artificial
  Chemically synthesized
ggcagcuccugcagaacc

SEQ ID NO: 17007 - RNA, 18 nt, artificial
  Chemically synthesized
cggugugggugggacauu

SEQ ID NO: 17008 - RNA, 18 nt, artificial
  Chemically synthesized
caauuccaaucucucuau

SEQ ID NO: 17009 - RNA, 18 nt, artificial
  Chemically synthesized
cuguggacaguggaagau

SEQ ID NO: 17010 - RNA, 18 nt, artificial
  Chemically synthesized
gccaggaucucucuagag

SEQ ID NO: 17011 - RNA, 18 nt, artificial
  Chemically synthesized
gagccugaggagaugagc

SEQ ID NO: 17012 - RNA, 18 nt, artificial
  Chemically synthesized
gggcuggcguggacagca

SEQ ID NO: 17013 - RNA, 18 nt, artificial
  Chemically synthesized
agccugaggagaugagcu

SEQ ID NO: 17014 - RNA, 18 nt, artificial
  Chemically synthesized
ccuggaacagugaauggg

SEQ ID NO: 17015 - RNA, 18 nt, artificial
  Chemically synthesized
ccuagcgccuucgacauu

SEQ ID NO: 17016 - RNA, 18 nt, artificial
  Chemically synthesized
guccgggagcccuucauu

SEQ ID NO: 17017 - RNA, 18 nt, artificial
  Chemically synthesized
auuucugggugaaggguc

SEQ ID NO: 17018 - RNA, 18 nt, artificial
  Chemically synthesized
cccucauuauccaccacg

SEQ ID NO: 17019 - RNA, 18 nt, artificial
  Chemically synthesized
cgggcaacuccgcagaag

SEQ ID NO: 17020 - RNA, 18 nt, artificial
  Chemically synthesized
caccaacuacccagugga

SEQ ID NO: 17021 - RNA, 18 nt, artificial
  Chemically synthesized
ggaacaugccuucaccac

SEQ ID NO: 17022 - RNA, 18 nt, artificial
  Chemically synthesized
ccaggaagguggccaaca

SEQ ID NO: 17023 - RNA, 18 nt, artificial
  Chemically synthesized
ccgccagugggcuggcgu

SEQ ID NO: 17024 - RNA, 18 nt, artificial
  Chemically synthesized
ccaccauccucggcuuug

SEQ ID NO: 17025 - RNA, 18 nt, artificial
  Chemically synthesized
cgggagcccuucauuuag

SEQ ID NO: 17026 - RNA, 18 nt, artificial
  Chemically synthesized
caagggugcucccugcga

SEQ ID NO: 17027 - RNA, 18 nt, artificial
  Chemically synthesized
ccagggcagacgaacaca

SEQ ID NO: 17028 - RNA, 18 nt, artificial
  Chemically synthesized
cucccaccauccucggcu

SEQ ID NO: 17029 - RNA, 18 nt, artificial
  Chemically synthesized
gccugagccugcaccagg

SEQ ID NO: 17030 - RNA, 18 nt, artificial
  Chemically synthesized
agccaagggugcucccug

SEQ ID NO: 17031 - RNA, 18 nt, artificial
  Chemically synthesized
gggcagcuccugcagaac

SEQ ID NO: 17032 - RNA, 18 nt, artificial
  Chemically synthesized
aggacgccauagaccacu

SEQ ID NO: 17033 - RNA, 18 nt, artificial
  Chemically synthesized
acaauuccaaucucucua

SEQ ID NO: 17034 - RNA, 18 nt, artificial
  Chemically synthesized
ccugcggguucgggagaa

SEQ ID NO: 17035 - RNA, 18 nt, artificial
  Chemically synthesized
ccagaugcaaccuccacu

SEQ ID NO: 17036 - RNA, 18 nt, artificial
  Chemically synthesized
aguggaagaugaggucau

SEQ ID NO: 17037 - RNA, 18 nt, artificial
  Chemically synthesized
cugcgggaacagagccaa

SEQ ID NO: 17038 - RNA, 18 nt, artificial
  Chemically synthesized
ccagaaaccagcaccaac

SEQ ID NO: 17039 - RNA, 18 nt, artificial
  Chemically synthesized
agauaccaccucuccaaa

SEQ ID NO: 17040 - RNA, 18 nt, artificial
  Chemically synthesized
guccuaccaggcacagau

SEQ ID NO: 17041 - RNA, 18 nt, artificial
  Chemically synthesized
gguggcuuuugggagcca

SEQ ID NO: 17042 - RNA, 18 nt, artificial
  Chemically synthesized
gauacgguguuuacaauu

SEQ ID NO: 17043 - RNA, 18 nt, artificial
  Chemically synthesized
ccacuuucaggacauugu

SEQ ID NO: 17044 - RNA, 18 nt, artificial
  Chemically synthesized
ccaggaucucucuagagg

SEQ ID NO: 17045 - RNA, 18 nt, artificial
  Chemically synthesized
ggcagacgaacacaucgc

SEQ ID NO: 17046 - RNA, 18 nt, artificial
  Chemically synthesized
ucaucuacuccuuguuca

SEQ ID NO: 17047 - RNA, 18 nt, artificial
  Chemically synthesized
ccagauguguccugggcu

SEQ ID NO: 17048 - RNA, 18 nt, artificial
  Chemically synthesized
cgaacacucccagaucuu

SEQ ID NO: 17049 - RNA, 18 nt, artificial
  Chemically synthesized
uguagaagauaccaccuc

SEQ ID NO: 17050 - RNA, 18 nt, artificial
  Chemically synthesized
cuauaacuuugugauccu

SEQ ID NO: 17051 - RNA, 18 nt, artificial
  Chemically synthesized
ggcuuugcccucugggac

SEQ ID NO: 17052 - RNA, 18 nt, artificial
  Chemically synthesized
gcaacuccgcagaagccc

SEQ ID NO: 17053 - RNA, 18 nt, artificial
  Chemically synthesized
ggaagguggccaacaccu

SEQ ID NO: 17054 - RNA, 18 nt, artificial
  Chemically synthesized
gaagggucuugguggugg

SEQ ID NO: 17055 - RNA, 18 nt, artificial
  Chemically synthesized
ggaaucaucaucggaaca

SEQ ID NO: 17056 - RNA, 18 nt, artificial
  Chemically synthesized
cccacaugggcccagcaa

SEQ ID NO: 17057 - RNA, 18 nt, artificial
  Chemically synthesized
ggacgcuccaguccaauc

SEQ ID NO: 17058 - RNA, 18 nt, artificial
  Chemically synthesized
cagacgccacuccaacuu

SEQ ID NO: 17059 - RNA, 18 nt, artificial
  Chemically synthesized
cccucagagcccagggcu

SEQ ID NO: 17060 - RNA, 18 nt, artificial
  Chemically synthesized
gacgccauagaccacuca

SEQ ID NO: 17061 - RNA, 18 nt, artificial
  Chemically synthesized
gcggcuggacgaacacuc

SEQ ID NO: 17062 - RNA, 18 nt, artificial
  Chemically synthesized
gggcaacuccgcagaagc

SEQ ID NO: 17063 - RNA, 18 nt, artificial
  Chemically synthesized
ccgccacccuuucccacu

SEQ ID NO: 17064 - RNA, 18 nt, artificial
  Chemically synthesized
cauccuacuucucaccuc

SEQ ID NO: 17065 - RNA, 18 nt, artificial
  Chemically synthesized
ggugcggcuggacgaaca

SEQ ID NO: 17066 - RNA, 18 nt, artificial
  Chemically synthesized
gaugcaaccuccacuggc

SEQ ID NO: 17067 - RNA, 18 nt, artificial
  Chemically synthesized
guggacaguggaagauga

SEQ ID NO: 17068 - RNA, 18 nt, artificial
  Chemically synthesized
ucuauaacuuugugaucc

SEQ ID NO: 17069 - RNA, 18 nt, artificial
  Chemically synthesized
gcucuuguaucugaagca

SEQ ID NO: 17070 - RNA, 18 nt, artificial
  Chemically synthesized
ggaccaggagccucccac

SEQ ID NO: 17071 - RNA, 18 nt, artificial
  Chemically synthesized
ggccuaccaggaagccgu

SEQ ID NO: 17072 - RNA, 18 nt, artificial
  Chemically synthesized
aucucucuauuucugggu

SEQ ID NO: 17073 - RNA, 18 nt, artificial
  Chemically synthesized
gcccuguggacaguggaa

SEQ ID NO: 17074 - RNA, 18 nt, artificial
  Chemically synthesized
agcccugcgggaacagag

SEQ ID NO: 17075 - RNA, 18 nt, artificial
  Chemically synthesized
accacauguggaaccaga

SEQ ID NO: 17076 - RNA, 18 nt, artificial
  Chemically synthesized
gccaacaccuucaagccc

SEQ ID NO: 17077 - RNA, 18 nt, artificial
  Chemically synthesized
guaucugaagcacaaacu

SEQ ID NO: 17078 - RNA, 18 nt, artificial
  Chemically synthesized
gcuuucaucauccuacuu

SEQ ID NO: 17079 - RNA, 18 nt, artificial
  Chemically synthesized
cagagagggucccaggcg

SEQ ID NO: 17080 - RNA, 18 nt, artificial
  Chemically synthesized
gccagacugugucauccc

SEQ ID NO: 17081 - RNA, 18 nt, artificial
  Chemically synthesized
gcccuuccucagccugca

SEQ ID NO: 17082 - RNA, 18 nt, artificial
  Chemically synthesized
gcagaaugaccgcguguc

SEQ ID NO: 17083 - RNA, 18 nt, artificial
  Chemically synthesized
ggaacuucaggaugaggc

SEQ ID NO: 17084 - RNA, 18 nt, artificial
  Chemically synthesized
ccaaucucucuauuucug

SEQ ID NO: 17085 - RNA, 18 nt, artificial
  Chemically synthesized
ggugcucccugcgaucca

SEQ ID NO: 17086 - RNA, 18 nt, artificial
  Chemically synthesized
gggaacagagccaacacc

SEQ ID NO: 17087 - RNA, 18 nt, artificial
  Chemically synthesized
gcagcuccagguggcuuu

SEQ ID NO: 17088 - RNA, 18 nt, artificial
  Chemically synthesized
aucacuuccuagcgccuu

SEQ ID NO: 17089 - RNA, 18 nt, artificial
  Chemically synthesized
ccuguggacaguggaaga

SEQ ID NO: 17090 - RNA, 18 nt, artificial
  Chemically synthesized
aggagccugaggagauga

SEQ ID NO: 17091 - RNA, 18 nt, artificial
  Chemically synthesized
cgcaggaggcagaaugac

SEQ ID NO: 17092 - RNA, 18 nt, artificial
  Chemically synthesized
cagggcagacgaacacau

SEQ ID NO: 17093 - RNA, 18 nt, artificial
  Chemically synthesized
cuaccaugcccuuccuca

SEQ ID NO: 17094 - RNA, 18 nt, artificial
  Chemically synthesized
gcauccggacgcuccagu

SEQ ID NO: 17095 - RNA, 18 nt, artificial
  Chemically synthesized
gcuacggucuuuuaauua

SEQ ID NO: 17096 - RNA, 18 nt, artificial
  Chemically synthesized
ggaaggaacaggacaccc

SEQ ID NO: 17097 - RNA, 18 nt, artificial
  Chemically synthesized
ggcugaggagaagcugug

SEQ ID NO: 17098 - RNA, 18 nt, artificial
  Chemically synthesized
guggaaccagagaggguc

SEQ ID NO: 17099 - RNA, 18 nt, artificial
  Chemically synthesized
cuagcgccuucgacauuc

SEQ ID NO: 17100 - RNA, 18 nt, artificial
  Chemically synthesized
gccugaggagaugagcug

SEQ ID NO: 17101 - RNA, 18 nt, artificial
  Chemically synthesized
gaggucaucugccacuuu

SEQ ID NO: 17102 - RNA, 18 nt, artificial
  Chemically synthesized
cauugacgguguuucgga

SEQ ID NO: 17103 - RNA, 18 nt, artificial
  Chemically synthesized
cccugugcccuguggaca

SEQ ID NO: 17104 - RNA, 18 nt, artificial
  Chemically synthesized
cuccaacuuucuguagaa

SEQ ID NO: 17105 - RNA, 18 nt, artificial
  Chemically synthesized
gguucgggagaagcugga

SEQ ID NO: 17106 - RNA, 18 nt, artificial
  Chemically synthesized
acuucucaccuccaacuu

SEQ ID NO: 17107 - RNA, 18 nt, artificial
  Chemically synthesized
ggugugggugggacauug

SEQ ID NO: 17108 - RNA, 18 nt, artificial
  Chemically synthesized
cagcaagcucugugacga

SEQ ID NO: 17109 - RNA, 18 nt, artificial
  Chemically synthesized
caagcucuuguaucugaa

SEQ ID NO: 17110 - RNA, 18 nt, artificial
  Chemically synthesized
cccaucacuuccuagcgc

SEQ ID NO: 17111 - RNA, 18 nt, artificial
  Chemically synthesized
uggaacagugaaugggua

SEQ ID NO: 17112 - RNA, 18 nt, artificial
  Chemically synthesized
ccagguggcuuuugggag

SEQ ID NO: 17113 - RNA, 18 nt, artificial
  Chemically synthesized
cuucauuuaggacaaaac

SEQ ID NO: 17114 - RNA, 18 nt, artificial
  Chemically synthesized
gacaguggaagaugaggu

SEQ ID NO: 17115 - RNA, 18 nt, artificial
  Chemically synthesized
guguuuacaauuccaauc

SEQ ID NO: 17116 - RNA, 18 nt, artificial
  Chemically synthesized
ggacaguggaagaugagg

SEQ ID NO: 17117 - RNA, 18 nt, artificial
  Chemically synthesized
ccacuggccucccugaua

SEQ ID NO: 17118 - RNA, 18 nt, artificial
  Chemically synthesized
cuggcugaggagaagcug

SEQ ID NO: 17119 - RNA, 18 nt, artificial
  Chemically synthesized
gcaggaggcagaaugacc

SEQ ID NO: 17120 - RNA, 18 nt, artificial
  Chemically synthesized
agcuacuuguccuaccag

SEQ ID NO: 17121 - RNA, 18 nt, artificial
  Chemically synthesized
gggcaggaccuccugcau

SEQ ID NO: 17122 - RNA, 18 nt, artificial
  Chemically synthesized
ccacagccagcagccuuu

SEQ ID NO: 17123 - RNA, 18 nt, artificial
  Chemically synthesized
cuacuucucaccuccaac

SEQ ID NO: 17124 - RNA, 18 nt, artificial
  Chemically synthesized
gagccaagggugcucccu

SEQ ID NO: 17125 - RNA, 18 nt, artificial
  Chemically synthesized
ccggacgcuccaguccaa

SEQ ID NO: 17126 - RNA, 18 nt, artificial
  Chemically synthesized
agccuaccuccagagcua

SEQ ID NO: 17127 - RNA, 18 nt, artificial
  Chemically synthesized
cugaacgcagccuacuca

SEQ ID NO: 17128 - RNA, 18 nt, artificial
  Chemically synthesized
gccuacucagccuaccuc

SEQ ID NO: 17129 - RNA, 18 nt, artificial
  Chemically synthesized
cucccuggaaucaucauc

SEQ ID NO: 17130 - RNA, 18 nt, artificial
  Chemically synthesized
ggucaucugccacuuuca

SEQ ID NO: 17131 - RNA, 18 nt, artificial
  Chemically synthesized
cauugaaggccgaugcgg

SEQ ID NO: 17132 - RNA, 18 nt, artificial
  Chemically synthesized
ccacaugucauuugggac

SEQ ID NO: 17133 - RNA, 18 nt, artificial
  Chemically synthesized
accaggugaaccaagcca

SEQ ID NO: 17134 - RNA, 18 nt, artificial
  Chemically synthesized
ggaagaugaggucaucug

SEQ ID NO: 17135 - RNA, 18 nt, artificial
  Chemically synthesized
gagccugcaccaggugaa

SEQ ID NO: 17136 - RNA, 18 nt, artificial
  Chemically synthesized
ggucgccagacuguguca

SEQ ID NO: 17137 - RNA, 18 nt, artificial
  Chemically synthesized
uguccuaccaggcacaga

SEQ ID NO: 17138 - RNA, 18 nt, artificial
  Chemically synthesized
auaccaccucuccaaaua

SEQ ID NO: 17139 - RNA, 18 nt, artificial
  Chemically synthesized
ccugcaugccaugguucu

SEQ ID NO: 17140 - RNA, 18 nt, artificial
  Chemically synthesized
gacccaguggcgcagccg

SEQ ID NO: 17141 - RNA, 18 nt, artificial
  Chemically synthesized
ggagcccuucauuuagga

SEQ ID NO: 17142 - RNA, 18 nt, artificial
  Chemically synthesized
cacaugucauuugggacu

SEQ ID NO: 17143 - RNA, 18 nt, artificial
  Chemically synthesized
cccugcucugucaaagac

SEQ ID NO: 17144 - RNA, 18 nt, artificial
  Chemically synthesized
ugaaccaagccaugauga

SEQ ID NO: 17145 - RNA, 18 nt, artificial
  Chemically synthesized
gcuuuugggagccacaug

SEQ ID NO: 17146 - RNA, 18 nt, artificial
  Chemically synthesized
ccaguggcgcagccggca

SEQ ID NO: 17147 - RNA, 18 nt, artificial
  Chemically synthesized
agcagcuccagguggcuu

SEQ ID NO: 17148 - RNA, 18 nt, artificial
  Chemically synthesized
cuuggaaaucagccaguc

SEQ ID NO: 17149 - RNA, 18 nt, artificial
  Chemically synthesized
ggcguggacagcaccgag

SEQ ID NO: 17150 - RNA, 18 nt, artificial
  Chemically synthesized
ccucccuggaaucaucau

SEQ ID NO: 17151 - RNA, 18 nt, artificial
  Chemically synthesized
cugggugaagggucuugg

SEQ ID NO: 17152 - RNA, 18 nt, artificial
  Chemically synthesized
gacugucgccugagccug

SEQ ID NO: 17153 - RNA, 18 nt, artificial
  Chemically synthesized
agccaugaugagcaaccu

SEQ ID NO: 17154 - RNA, 18 nt, artificial
  Chemically synthesized
cgaugaugcccuggcuuu

SEQ ID NO: 17155 - RNA, 18 nt, artificial
  Chemically synthesized
gcgaugaugcccuggcuu

SEQ ID NO: 17156 - RNA, 18 nt, artificial
  Chemically synthesized
ccaggaagccguccgcac

SEQ ID NO: 17157 - RNA, 18 nt, artificial
  Chemically synthesized
acgccauagaccacucag

SEQ ID NO: 17158 - RNA, 18 nt, artificial
  Chemically synthesized
uggcuuucagggugguca

SEQ ID NO: 17159 - RNA, 18 nt, artificial
  Chemically synthesized
cuucgacugucgccugag

SEQ ID NO: 17160 - RNA, 18 nt, artificial
  Chemically synthesized
ccugcagaaccuggaaca

SEQ ID NO: 17161 - RNA, 18 nt, artificial
  Chemically synthesized
gggagauugccagcccac

SEQ ID NO: 17162 - RNA, 18 nt, artificial
  Chemically synthesized
caagccaugaugagcaac

SEQ ID NO: 17163 - RNA, 18 nt, artificial
  Chemically synthesized
ccaagccaugaugagcaa

SEQ ID NO: 17164 - RNA, 18 nt, artificial
  Chemically synthesized
gcccuggcuuucagggug

SEQ ID NO: 17165 - RNA, 18 nt, artificial
  Chemically synthesized
cauuguccgggagcccuu

SEQ ID NO: 17166 - RNA, 18 nt, artificial
  Chemically synthesized
agggcagacgaacacauc

SEQ ID NO: 17167 - RNA, 18 nt, artificial
  Chemically synthesized
cgggaacagagccaacac

SEQ ID NO: 17168 - RNA, 18 nt, artificial
  Chemically synthesized
cgccacccuuucccacuu

SEQ ID NO: 17169 - RNA, 18 nt, artificial
  Chemically synthesized
gagaugagcuggccgcca

SEQ ID NO: 17170 - RNA, 18 nt, artificial
  Chemically synthesized
cgguguuucggacuggag

SEQ ID NO: 17171 - RNA, 18 nt, artificial
  Chemically synthesized
gcaggcggcggcacugaa

SEQ ID NO: 17172 - RNA, 18 nt, artificial
  Chemically synthesized
ccagacgccacuccaacu

SEQ ID NO: 17173 - RNA, 18 nt, artificial
  Chemically synthesized
ucuacuccuuguucagcu

SEQ ID NO: 17174 - RNA, 18 nt, artificial
  Chemically synthesized
gaucucucuagaggcauu

SEQ ID NO: 17175 - RNA, 18 nt, artificial
  Chemically synthesized
uggauacgguguuuacaa

SEQ ID NO: 17176 - RNA, 18 nt, artificial
  Chemically synthesized
ccuuccucccuggaauca

SEQ ID NO: 17177 - RNA, 18 nt, artificial
  Chemically synthesized
gcuggacgaacacuccca

SEQ ID NO: 17178 - RNA, 18 nt, artificial
  Chemically synthesized
ucucuauuucugggugaa

SEQ ID NO: 17179 - RNA, 18 nt, artificial
  Chemically synthesized
gcaguguggaacaugccu

SEQ ID NO: 17180 - RNA, 18 nt, artificial
  Chemically synthesized
ucuauuucugggugaagg

SEQ ID NO: 17181 - RNA, 18 nt, artificial
  Chemically synthesized
caugguucuccugaagcu

SEQ ID NO: 17182 - RNA, 18 nt, artificial
  Chemically synthesized
ccagugggcuggcgugga

SEQ ID NO: 17183 - RNA, 18 nt, artificial
  Chemically synthesized
uuccaaucucucuauuuc

SEQ ID NO: 17184 - RNA, 18 nt, artificial
  Chemically synthesized
ggcacagauggagcagcu

SEQ ID NO: 17185 - RNA, 18 nt, artificial
  Chemically synthesized
cccagaugcaaccuccac

SEQ ID NO: 17186 - RNA, 18 nt, artificial
  Chemically synthesized
gaacaugccuucaccacc

SEQ ID NO: 17187 - RNA, 18 nt, artificial
  Chemically synthesized
gcugaacaaccacaugug

SEQ ID NO: 17188 - RNA, 18 nt, artificial
  Chemically synthesized
ggcccaucacuuccuagc

SEQ ID NO: 17189 - RNA, 18 nt, artificial
  Chemically synthesized
ccuccugcaugccauggu

SEQ ID NO: 17190 - RNA, 18 nt, artificial
  Chemically synthesized
ggaugcaggcggcggcac

SEQ ID NO: 17191 - RNA, 18 nt, artificial
  Chemically synthesized
ggaggcagaaugaccgcg

SEQ ID NO: 17192 - RNA, 18 nt, artificial
  Chemically synthesized
ccaggacaagcucuugua

SEQ ID NO: 17193 - RNA, 18 nt, artificial
  Chemically synthesized
cugcaccaggugaaccaa

SEQ ID NO: 17194 - RNA, 18 nt, artificial
  Chemically synthesized
caucauccuacuucucac

SEQ ID NO: 17195 - RNA, 18 nt, artificial
  Chemically synthesized
cgccagacugugucaucc

SEQ ID NO: 17196 - RNA, 18 nt, artificial
  Chemically synthesized
gguauugcuacggucuuu

SEQ ID NO: 17197 - RNA, 18 nt, artificial
  Chemically synthesized
acuacccaguggagugca

SEQ ID NO: 17198 - RNA, 18 nt, artificial
  Chemically synthesized
gcgggcaacuccgcagaa

SEQ ID NO: 17199 - RNA, 18 nt, artificial
  Chemically synthesized
agacgaacacaucgcccu

SEQ ID NO: 17200 - RNA, 18 nt, artificial
  Chemically synthesized
gcggcggcacugaacgca

SEQ ID NO: 17201 - RNA, 18 nt, artificial
  Chemically synthesized
caccacgcacagauggua

SEQ ID NO: 17202 - RNA, 18 nt, artificial
  Chemically synthesized
agaaugaccgcguguccu

SEQ ID NO: 17203 - RNA, 18 nt, artificial
  Chemically synthesized
ccuguucccuuccucccu

SEQ ID NO: 17204 - RNA, 18 nt, artificial
  Chemically synthesized
acgaacacucccagaucu

SEQ ID NO: 17205 - RNA, 18 nt, artificial
  Chemically synthesized
cucuagaggcauugaagg

SEQ ID NO: 17206 - RNA, 18 nt, artificial
  Chemically synthesized
aggacaagacgcaggagg

SEQ ID NO: 17207 - RNA, 18 nt, artificial
  Chemically synthesized
ggaucccugaucugcuug

SEQ ID NO: 17208 - RNA, 18 nt, artificial
  Chemically synthesized
gagccacaugucauuugg

SEQ ID NO: 17209 - RNA, 18 nt, artificial
  Chemically synthesized
cccgaaaggccaugugga

SEQ ID NO: 17210 - RNA, 18 nt, artificial
  Chemically synthesized
caacuucgacugucgccu

SEQ ID NO: 17211 - RNA, 18 nt, artificial
  Chemically synthesized
ggagcugagcugccugca

SEQ ID NO: 17212 - RNA, 18 nt, artificial
  Chemically synthesized
cggcggcacugaacgcag

SEQ ID NO: 17213 - RNA, 18 nt, artificial
  Chemically synthesized
gacaagacgcaggaggca

SEQ ID NO: 17214 - RNA, 18 nt, artificial
  Chemically synthesized
acuuggaaaucagccagu

SEQ ID NO: 17215 - RNA, 18 nt, artificial
  Chemically synthesized
gggagcauccggacgcuc

SEQ ID NO: 17216 - RNA, 18 nt, artificial
  Chemically synthesized
gucagaacuggauacggu

SEQ ID NO: 17217 - RNA, 18 nt, artificial
  Chemically synthesized
ggcugguggcccgccagu

SEQ ID NO: 17218 - RNA, 18 nt, artificial
  Chemically synthesized
ccuggacggugagcggau

SEQ ID NO: 17219 - RNA, 18 nt, artificial
  Chemically synthesized
ugccuauucuggagccgg

SEQ ID NO: 17220 - RNA, 18 nt, artificial
  Chemically synthesized
ccugcaccgcagcccaca

SEQ ID NO: 17221 - RNA, 18 nt, artificial
  Chemically synthesized
ggcccagcucagcuccga

SEQ ID NO: 17222 - RNA, 18 nt, artificial
  Chemically synthesized
gacguggccuaccaggaa

SEQ ID NO: 17223 - RNA, 18 nt, artificial
  Chemically synthesized
cgccagggcagacgaaca

SEQ ID NO: 17224 - RNA, 18 nt, artificial
  Chemically synthesized
ccaaauaccaagccgugc

SEQ ID NO: 17225 - RNA, 18 nt, artificial
  Chemically synthesized
cgcacagaugguacagcu

SEQ ID NO: 17226 - RNA, 18 nt, artificial
  Chemically synthesized
gcuccagggacgaccacc

SEQ ID NO: 17227 - RNA, 18 nt, artificial
  Chemically synthesized
cuuguucagcucaccuga

SEQ ID NO: 17228 - RNA, 18 nt, artificial
  Chemically synthesized
ccagaucuucgccaggaa

SEQ ID NO: 17229 - RNA, 18 nt, artificial
  Chemically synthesized
cugcucugucaaagacca

SEQ ID NO: 17230 - RNA, 18 nt, artificial
  Chemically synthesized
ccacagucacugcccuuc

SEQ ID NO: 17231 - RNA, 18 nt, artificial
  Chemically synthesized
gaggccaggaucucucua

SEQ ID NO: 17232 - RNA, 18 nt, artificial
  Chemically synthesized
ggacauuguccgggagcc

SEQ ID NO: 17233 - RNA, 18 nt, artificial
  Chemically synthesized
cgcccugcggguucggga

SEQ ID NO: 17234 - RNA, 18 nt, artificial
  Chemically synthesized
cugccaggagccugagga

SEQ ID NO: 17235 - RNA, 18 nt, artificial
  Chemically synthesized
ugggcugccucccaccau

SEQ ID NO: 17236 - RNA, 18 nt, artificial
  Chemically synthesized
ccaccuacucccaccacc

SEQ ID NO: 17237 - RNA, 18 nt, artificial
  Chemically synthesized
ggcuggcguggacagcac

SEQ ID NO: 17238 - RNA, 18 nt, artificial
  Chemically synthesized
caggacaagcucuuguau

SEQ ID NO: 17239 - RNA, 18 nt, artificial
  Chemically synthesized
uggacgaacacucccaga

SEQ ID NO: 17240 - RNA, 18 nt, artificial
  Chemically synthesized
cacagaugguacagcugg

SEQ ID NO: 17241 - RNA, 18 nt, artificial
  Chemically synthesized
caaagaccagacgccacu

SEQ ID NO: 17242 - RNA, 18 nt, artificial
  Chemically synthesized
agcuuucaucauccuacu

SEQ ID NO: 17243 - RNA, 18 nt, artificial
  Chemically synthesized
cgccauagaccacucagc

SEQ ID NO: 17244 - RNA, 18 nt, artificial
  Chemically synthesized
gggcugccucccaccauc

SEQ ID NO: 17245 - RNA, 18 nt, artificial
  Chemically synthesized
gaacaaccacauguggaa

SEQ ID NO: 17246 - RNA, 18 nt, artificial
  Chemically synthesized
ucagcuuucaucauccua

SEQ ID NO: 17247 - RNA, 18 nt, artificial
  Chemically synthesized
ccuucaccaccuccagcu

SEQ ID NO: 17248 - RNA, 18 nt, artificial
  Chemically synthesized
gcccaucacuuccuagcg

SEQ ID NO: 17249 - RNA, 18 nt, artificial
  Chemically synthesized
ccaccuccagcuucugcu

SEQ ID NO: 17250 - RNA, 18 nt, artificial
  Chemically synthesized
gacacugggcgugcagaa

SEQ ID NO: 17251 - RNA, 18 nt, artificial
  Chemically synthesized
ggacggugagcggaugca

SEQ ID NO: 17252 - RNA, 18 nt, artificial
  Chemically synthesized
cgcagccuacucagccua

SEQ ID NO: 17253 - RNA, 18 nt, artificial
  Chemically synthesized
gggcucgaaugcccuuug

SEQ ID NO: 17254 - RNA, 18 nt, artificial
  Chemically synthesized
gagauugccagcccacca

SEQ ID NO: 17255 - RNA, 18 nt, artificial
  Chemically synthesized
gaagcacaaacugaagac

SEQ ID NO: 17256 - RNA, 18 nt, artificial
  Chemically synthesized
cuuuugggagccacaugu

SEQ ID NO: 17257 - RNA, 18 nt, artificial
  Chemically synthesized
cagagcuacuuguccuac

SEQ ID NO: 17258 - RNA, 18 nt, artificial
  Chemically synthesized
aggguggucagaacugga

SEQ ID NO: 17259 - RNA, 18 nt, artificial
  Chemically synthesized
gaacacucccagaucuuc

SEQ ID NO: 17260 - RNA, 18 nt, artificial
  Chemically synthesized
gaggcugcacccaccugu

SEQ ID NO: 17261 - RNA, 18 nt, artificial
  Chemically synthesized
cuguagaagauaccaccu

SEQ ID NO: 17262 - RNA, 18 nt, artificial
  Chemically synthesized
cgauccacuggcagcccu

SEQ ID NO: 17263 - RNA, 18 nt, artificial
  Chemically synthesized
cagcccaccuccugggcu

SEQ ID NO: 17264 - RNA, 18 nt, artificial
  Chemically synthesized
uguggaaccagagagggu

SEQ ID NO: 17265 - RNA, 18 nt, artificial
  Chemically synthesized
uccucagccugcaccgca

SEQ ID NO: 17266 - RNA, 18 nt, artificial
  Chemically synthesized
caacuuggaaaucagcca

SEQ ID NO: 17267 - RNA, 18 nt, artificial
  Chemically synthesized
acucccagaucuucgcca

SEQ ID NO: 17268 - RNA, 18 nt, artificial
  Chemically synthesized
gaaccagagaggguccca

SEQ ID NO: 17269 - RNA, 18 nt, artificial
  Chemically synthesized
ccacuccaacuuucugua

SEQ ID NO: 17270 - RNA, 18 nt, artificial
  Chemically synthesized
gacgccacuccaacuuuc

SEQ ID NO: 17271 - RNA, 18 nt, artificial
  Chemically synthesized
cccaccauccucggcuuu

SEQ ID NO: 17272 - RNA, 18 nt, artificial
  Chemically synthesized
gcgaggauuuccaggugc

SEQ ID NO: 17273 - RNA, 18 nt, artificial
  Chemically synthesized
gcacagauggagcagcuc

SEQ ID NO: 17274 - RNA, 18 nt, artificial
  Chemically synthesized
ggacccaguggcgcagcc

SEQ ID NO: 17275 - RNA, 18 nt, artificial
  Chemically synthesized
cucuccaaauaccaagcc

SEQ ID NO: 17276 - RNA, 18 nt, artificial
  Chemically synthesized
gacauucuaggugcagca

SEQ ID NO: 17277 - RNA, 18 nt, artificial
  Chemically synthesized
gccacccuuucccacuug

SEQ ID NO: 17278 - RNA, 18 nt, artificial
  Chemically synthesized
gcuuguaccaccugcugg

SEQ ID NO: 17279 - RNA, 18 nt, artificial
  Chemically synthesized
gccuauucuggagccggu

SEQ ID NO: 17280 - RNA, 18 nt, artificial
  Chemically synthesized
accagacgccacuccaac

SEQ ID NO: 17281 - RNA, 18 nt, artificial
  Chemically synthesized
uugugauccuccacgcca

SEQ ID NO: 17282 - RNA, 18 nt, artificial
  Chemically synthesized
ggcuguggcccgcuugua

SEQ ID NO: 17283 - RNA, 18 nt, artificial
  Chemically synthesized
gaagguggccaacaccuu

SEQ ID NO: 17284 - RNA, 18 nt, artificial
  Chemically synthesized
agcaccaacuacccagug

SEQ ID NO: 17285 - RNA, 18 nt, artificial
  Chemically synthesized
ccucccuguucccuuccu

SEQ ID NO: 17286 - RNA, 18 nt, artificial
  Chemically synthesized
ggaagccguccgcacccu

SEQ ID NO: 17287 - RNA, 18 nt, artificial
  Chemically synthesized
gcuacuuguccuaccagg

SEQ ID NO: 17288 - RNA, 18 nt, artificial
  Chemically synthesized
gugggugggacauugcug

SEQ ID NO: 17289 - RNA, 18 nt, artificial
  Chemically synthesized
gagccagcgcccucagcg

SEQ ID NO: 17290 - RNA, 18 nt, artificial
  Chemically synthesized
guguggaacaugccuuca

SEQ ID NO: 17291 - RNA, 18 nt, artificial
  Chemically synthesized
ggcaguguggaacaugcc

SEQ ID NO: 17292 - RNA, 18 nt, artificial
  Chemically synthesized
cacagucacugcccuucc

SEQ ID NO: 17293 - RNA, 18 nt, artificial
  Chemically synthesized
ggcaacuccgcagaagcc

SEQ ID NO: 17294 - RNA, 18 nt, artificial
  Chemically synthesized
cacugggcgugcagaagg

SEQ ID NO: 17295 - RNA, 18 nt, artificial
  Chemically synthesized
cgccuucgacauucuagg

SEQ ID NO: 17296 - RNA, 18 nt, artificial
  Chemically synthesized
ccuuccucagccugcacc

SEQ ID NO: 17297 - RNA, 18 nt, artificial
  Chemically synthesized
gagcuacuuguccuacca

SEQ ID NO: 17298 - RNA, 18 nt, artificial
  Chemically synthesized
cccagcucagcuccgaca

SEQ ID NO: 17299 - RNA, 18 nt, artificial
  Chemically synthesized
cccaccuacucccaccac

SEQ ID NO: 17300 - RNA, 18 nt, artificial
  Chemically synthesized
gauggagcagcuccaggu

SEQ ID NO: 17301 - RNA, 18 nt, artificial
  Chemically synthesized
gcacugaacgcagccuac

SEQ ID NO: 17302 - RNA, 18 nt, artificial
  Chemically synthesized
acauguggaaccagagag

SEQ ID NO: 17303 - RNA, 18 nt, artificial
  Chemically synthesized
acuuugugauccuccacg

SEQ ID NO: 17304 - RNA, 18 nt, artificial
  Chemically synthesized
ccaccugcuggcugagga

SEQ ID NO: 17305 - RNA, 18 nt, artificial
  Chemically synthesized
ggagaagcuggaggcccu

SEQ ID NO: 17306 - RNA, 18 nt, artificial
  Chemically synthesized
cugccacuuucaggacau

SEQ ID NO: 17307 - RNA, 18 nt, artificial
  Chemically synthesized
gggaccaggagccuccca

SEQ ID NO: 17308 - RNA, 18 nt, artificial
  Chemically synthesized
gaaugaccgcguguccuu

SEQ ID NO: 17309 - RNA, 18 nt, artificial
  Chemically synthesized
cggcuuugcccucuggga

SEQ ID NO: 17310 - RNA, 18 nt, artificial
  Chemically synthesized
ccagcuucugcugccgga

SEQ ID NO: 17311 - RNA, 18 nt, artificial
  Chemically synthesized
cugcacgcauggcaggcu

SEQ ID NO: 17312 - RNA, 18 nt, artificial
  Chemically synthesized
caccgaggacccagagga

SEQ ID NO: 17313 - RNA, 18 nt, artificial
  Chemically synthesized
caaccacauguggaacca

SEQ ID NO: 17314 - RNA, 18 nt, artificial
  Chemically synthesized
caacuacccaguggagug

SEQ ID NO: 17315 - RNA, 18 nt, artificial
  Chemically synthesized
ucuggagccggucaaaaa

SEQ ID NO: 17316 - RNA, 18 nt, artificial
  Chemically synthesized
ucaucggaacagaaauuc

SEQ ID NO: 17317 - RNA, 18 nt, artificial
  Chemically synthesized
uacuuguccuaccaggca

SEQ ID NO: 17318 - RNA, 18 nt, artificial
  Chemically synthesized
ugaagcacaaacugaaga

SEQ ID NO: 17319 - RNA, 18 nt, artificial
  Chemically synthesized
cuaccaggcacagaugga

SEQ ID NO: 17320 - RNA, 18 nt, artificial
  Chemically synthesized
cccuccucccuguucccu

SEQ ID NO: 17321 - RNA, 18 nt, artificial
  Chemically synthesized
ggaggcugcacccaccug

SEQ ID NO: 17322 - RNA, 18 nt, artificial
  Chemically synthesized
cucugucaaagaccagac

SEQ ID NO: 17323 - RNA, 18 nt, artificial
  Chemically synthesized
gaggacaagacgcaggag

SEQ ID NO: 17324 - RNA, 18 nt, artificial
  Chemically synthesized
uggaagaugaggucaucu

SEQ ID NO: 17325 - RNA, 18 nt, artificial
  Chemically synthesized
acccaguggcgcagccgg

SEQ ID NO: 17326 - RNA, 18 nt, artificial
  Chemically synthesized
gcagcuccugcagaaccu

SEQ ID NO: 17327 - RNA, 18 nt, artificial
  Chemically synthesized
ucccuuccucccuggaau

SEQ ID NO: 17328 - RNA, 18 nt, artificial
  Chemically synthesized
ccuccacgccagggcaga

SEQ ID NO: 17329 - RNA, 18 nt, artificial
  Chemically synthesized
cuccagagcuacuugucc

SEQ ID NO: 17330 - RNA, 18 nt, artificial
  Chemically synthesized
gcagccuacucagccuac

SEQ ID NO: 17331 - RNA, 18 nt, artificial
  Chemically synthesized
cugcaggacgccauagac

SEQ ID NO: 17332 - RNA, 18 nt, artificial
  Chemically synthesized
gugagcggaugcaggcgg

SEQ ID NO: 17333 - RNA, 18 nt, artificial
  Chemically synthesized
accacucagcuuucauca

SEQ ID NO: 17334 - RNA, 18 nt, artificial
  Chemically synthesized
cgccugagccugcaccag

SEQ ID NO: 17335 - RNA, 18 nt, artificial
  Chemically synthesized
ggccaacaccuucaagcc

SEQ ID NO: 17336 - RNA, 18 nt, artificial
  Chemically synthesized
cgacugucgccugagccu

SEQ ID NO: 17337 - RNA, 18 nt, artificial
  Chemically synthesized
cgggcgcgaugaugcccu

SEQ ID NO: 17338 - RNA, 18 nt, artificial
  Chemically synthesized
uauuucugggugaagggu

SEQ ID NO: 17339 - RNA, 18 nt, artificial
  Chemically synthesized
ugcaccaggugaaccaag

SEQ ID NO: 17340 - RNA, 18 nt, artificial
  Chemically synthesized
ccagcucagcuccgacac

SEQ ID NO: 17341 - RNA, 18 nt, artificial
  Chemically synthesized
cccggaucccugaucugc

SEQ ID NO: 17342 - RNA, 18 nt, artificial
  Chemically synthesized
accucuccaaauaccaag

SEQ ID NO: 17343 - RNA, 18 nt, artificial
  Chemically synthesized
ccgcagcuccagaaacca

SEQ ID NO: 17344 - RNA, 18 nt, artificial
  Chemically synthesized
cacuuucaggacauuguc

SEQ ID NO: 17345 - RNA, 18 nt, artificial
  Chemically synthesized
ggugagcggaugcaggcg

SEQ ID NO: 17346 - RNA, 18 nt, artificial
  Chemically synthesized
gaggcauugaaggccgau

SEQ ID NO: 17347 - RNA, 18 nt, artificial
  Chemically synthesized
guggaggaaggaacagga

SEQ ID NO: 17348 - RNA, 18 nt, artificial
  Chemically synthesized
uggcugaggagaagcugu

SEQ ID NO: 17349 - RNA, 18 nt, artificial
  Chemically synthesized
ggagccagcgcccucagc

SEQ ID NO: 17350 - RNA, 18 nt, artificial
  Chemically synthesized
uggccagcaacuuggaaa

SEQ ID NO: 17351 - RNA, 18 nt, artificial
  Chemically synthesized
cugcgaggauuuccaggu

SEQ ID NO: 17352 - RNA, 18 nt, artificial
  Chemically synthesized
cgcauggcaggcuggcac

SEQ ID NO: 17353 - RNA, 18 nt, artificial
  Chemically synthesized
ccaucacuuccuagcgcc

SEQ ID NO: 17354 - RNA, 18 nt, artificial
  Chemically synthesized
ccagcaccaacuacccag

SEQ ID NO: 17355 - RNA, 18 nt, artificial
  Chemically synthesized
ggacccaggcaucggcca

SEQ ID NO: 17356 - RNA, 18 nt, artificial
  Chemically synthesized
cccuguucccuuccuccc

SEQ ID NO: 17357 - RNA, 18 nt, artificial
  Chemically synthesized
gcugccugcaggacgcca

SEQ ID NO: 17358 - RNA, 18 nt, artificial
  Chemically synthesized
uccagaaaccagcaccaa

SEQ ID NO: 17359 - RNA, 18 nt, artificial
  Chemically synthesized
cuaccuccagagcuacuu

SEQ ID NO: 17360 - RNA, 18 nt, artificial
  Chemically synthesized
uguggaacaugccuucac

SEQ ID NO: 17361 - RNA, 18 nt, artificial
  Chemically synthesized
agcccaccuccugggcuu

SEQ ID NO: 17362 - RNA, 18 nt, artificial
  Chemically synthesized
guggagccagcgcccuca

SEQ ID NO: 17363 - RNA, 18 nt, artificial
  Chemically synthesized
cauuauccaccacgcaca

SEQ ID NO: 17364 - RNA, 18 nt, artificial
  Chemically synthesized
agcucagcuccgacacgg

SEQ ID NO: 17365 - RNA, 18 nt, artificial
  Chemically synthesized
cugcggguucgggagaag

SEQ ID NO: 17366 - RNA, 18 nt, artificial
  Chemically synthesized
uacuccuuguucagcuca

SEQ ID NO: 17367 - RNA, 18 nt, artificial
  Chemically synthesized
ccuggacccaggcaucgg

SEQ ID NO: 17368 - RNA, 18 nt, artificial
  Chemically synthesized
cggccagccugcucuccg

SEQ ID NO: 17369 - RNA, 18 nt, artificial
  Chemically synthesized
caguggcgcagccggcag

SEQ ID NO: 17370 - RNA, 18 nt, artificial
  Chemically synthesized
cggaucccugaucugcuu

SEQ ID NO: 17371 - RNA, 18 nt, artificial
  Chemically synthesized
cagagcccagggcugcaa

SEQ ID NO: 17372 - RNA, 18 nt, artificial
  Chemically synthesized
ugggcgugcagaaggcgg

SEQ ID NO: 17373 - RNA, 18 nt, artificial
  Chemically synthesized
acuccuuguucagcucac

SEQ ID NO: 17374 - RNA, 18 nt, artificial
  Chemically synthesized
cucccuggccagcaacuu

SEQ ID NO: 17375 - RNA, 18 nt, artificial
  Chemically synthesized
gggaacuucaggaugagg

SEQ ID NO: 17376 - RNA, 18 nt, artificial
  Chemically synthesized
acuuucuguagaagauac

SEQ ID NO: 17377 - RNA, 18 nt, artificial
  Chemically synthesized
gaaaccagcaccaacuac

SEQ ID NO: 17378 - RNA, 18 nt, artificial
  Chemically synthesized
ugcggguucgggagaagc

SEQ ID NO: 17379 - RNA, 18 nt, artificial
  Chemically synthesized
gauugccagcccaccaga

SEQ ID NO: 17380 - RNA, 18 nt, artificial
  Chemically synthesized
ugcggcuggacgaacacu

SEQ ID NO: 17381 - RNA, 18 nt, artificial
  Chemically synthesized
cuggagccggucaaaaac

SEQ ID NO: 17382 - RNA, 18 nt, artificial
  Chemically synthesized
ucuccaaauaccaagccg

SEQ ID NO: 17383 - RNA, 18 nt, artificial
  Chemically synthesized
gggcgugcagaaggcggg

SEQ ID NO: 17384 - RNA, 18 nt, artificial
  Chemically synthesized
aggaccuccugcaugcca

SEQ ID NO: 17385 - RNA, 18 nt, artificial
  Chemically synthesized
ggagccggucaaaaaccc

SEQ ID NO: 17386 - RNA, 18 nt, artificial
  Chemically synthesized
gaacagagccaacaccug

SEQ ID NO: 17387 - RNA, 18 nt, artificial
  Chemically synthesized
agccuacucagccuaccu

SEQ ID NO: 17388 - RNA, 18 nt, artificial
  Chemically synthesized
ggcugccaggagccugag

SEQ ID NO: 17389 - RNA, 18 nt, artificial
  Chemically synthesized
acauuguccgggagcccu

SEQ ID NO: 17390 - RNA, 18 nt, artificial
  Chemically synthesized
ugggugaagggucuuggu

SEQ ID NO: 17391 - RNA, 18 nt, artificial
  Chemically synthesized
ugccaugguucuccugaa

SEQ ID NO: 17392 - RNA, 18 nt, artificial
  Chemically synthesized
gccuucgacauucuaggu

SEQ ID NO: 17393 - RNA, 18 nt, artificial
  Chemically synthesized
cuauuucugggugaaggg

SEQ ID NO: 17394 - RNA, 18 nt, artificial
  Chemically synthesized
ccacaugggcccagcaag

SEQ ID NO: 17395 - RNA, 18 nt, artificial
  Chemically synthesized
cccucagcgcgcuacggu

SEQ ID NO: 17396 - RNA, 18 nt, artificial
  Chemically synthesized
cugccaagcagcccaccu

SEQ ID NO: 17397 - RNA, 18 nt, artificial
  Chemically synthesized
cuucaccaccuccagcuu

SEQ ID NO: 17398 - RNA, 18 nt, artificial
  Chemically synthesized
uugggagccacaugucau

SEQ ID NO: 17399 - RNA, 18 nt, artificial
  Chemically synthesized
agccugcaccgcagccca

SEQ ID NO: 17400 - RNA, 18 nt, artificial
  Chemically synthesized
agagagggucccaggcgc

SEQ ID NO: 17401 - RNA, 18 nt, artificial
  Chemically synthesized
ugcacaggcccaucacuu

SEQ ID NO: 17402 - RNA, 18 nt, artificial
  Chemically synthesized
cagacgaacacaucgccc

SEQ ID NO: 17403 - RNA, 18 nt, artificial
  Chemically synthesized
ccugagccugcaccaggu

SEQ ID NO: 17404 - RNA, 18 nt, artificial
  Chemically synthesized
cuccugcagaaccuggaa

SEQ ID NO: 17405 - RNA, 18 nt, artificial
  Chemically synthesized
caggcuucaggcccgaaa

SEQ ID NO: 17406 - RNA, 18 nt, artificial
  Chemically synthesized
cucauuauccaccacgca

SEQ ID NO: 17407 - RNA, 18 nt, artificial
  Chemically synthesized
ucauccuacuucucaccu

SEQ ID NO: 17408 - RNA, 18 nt, artificial
  Chemically synthesized
gguggccaacaccuucaa

SEQ ID NO: 17409 - RNA, 18 nt, artificial
  Chemically synthesized
cccucugggaccaggagc

SEQ ID NO: 17410 - RNA, 18 nt, artificial
  Chemically synthesized
ggccagcaacuuggaaau

SEQ ID NO: 17411 - RNA, 18 nt, artificial
  Chemically synthesized
cagccuacucagccuacc

SEQ ID NO: 17412 - RNA, 18 nt, artificial
  Chemically synthesized
guccaaucugggcugccu

SEQ ID NO: 17413 - RNA, 18 nt, artificial
  Chemically synthesized
uggaaaucagccaguccc

SEQ ID NO: 17414 - RNA, 18 nt, artificial
  Chemically synthesized
ggaugaggcccgaaaccg

SEQ ID NO: 17415 - RNA, 18 nt, artificial
  Chemically synthesized
acucagccuaccuccaga

SEQ ID NO: 17416 - RNA, 18 nt, artificial
  Chemically synthesized
aggcacagauggagcagc

SEQ ID NO: 17417 - RNA, 18 nt, artificial
  Chemically synthesized
cucccuguucccuuccuc

SEQ ID NO: 17418 - RNA, 18 nt, artificial
  Chemically synthesized
caccagagcugccaagca

SEQ ID NO: 17419 - RNA, 18 nt, artificial
  Chemically synthesized
guccuugccugaccaccu

SEQ ID NO: 17420 - RNA, 18 nt, artificial
  Chemically synthesized
ccaagccgugcccaccua

SEQ ID NO: 17421 - RNA, 18 nt, artificial
  Chemically synthesized
accuccaacuucgacugu

SEQ ID NO: 17422 - RNA, 18 nt, artificial
  Chemically synthesized
acgccacuccaacuuucu

SEQ ID NO: 17423 - RNA, 18 nt, artificial
  Chemically synthesized
gagcaaccucacgcgaca

SEQ ID NO: 17424 - RNA, 18 nt, artificial
  Chemically synthesized
cugucgccugagccugca

SEQ ID NO: 17425 - RNA, 18 nt, artificial
  Chemically synthesized
cgaggacaagacgcagga

SEQ ID NO: 17426 - RNA, 18 nt, artificial
  Chemically synthesized
ccguccgcacccucagcu

SEQ ID NO: 17427 - RNA, 18 nt, artificial
  Chemically synthesized
agaaaccagcaccaacua

SEQ ID NO: 17428 - RNA, 18 nt, artificial
  Chemically synthesized
gcacccaccugugcccau

SEQ ID NO: 17429 - RNA, 18 nt, artificial
  Chemically synthesized
ucgacauucuaggugcag

SEQ ID NO: 17430 - RNA, 18 nt, artificial
  Chemically synthesized
ccaggagccucccacgcc

SEQ ID NO: 17431 - RNA, 18 nt, artificial
  Chemically synthesized
ccaggacccaguggcgca

SEQ ID NO: 17432 - RNA, 18 nt, artificial
  Chemically synthesized
agcggaugcaggcggcgg

SEQ ID NO: 17433 - RNA, 18 nt, artificial
  Chemically synthesized
gcuccaguccaaucuggg

SEQ ID NO: 17434 - RNA, 18 nt, artificial
  Chemically synthesized
uuucaucauccuacuucu

SEQ ID NO: 17435 - RNA, 18 nt, artificial
  Chemically synthesized
aucuacuccuuguucagc

SEQ ID NO: 17436 - RNA, 18 nt, artificial
  Chemically synthesized
gcccucugggaccaggag

SEQ ID NO: 17437 - RNA, 18 nt, artificial
  Chemically synthesized
cucaccuccaacuucgac

SEQ ID NO: 17438 - RNA, 18 nt, artificial
  Chemically synthesized
gcccagcaagcucuguga

SEQ ID NO: 17439 - RNA, 18 nt, artificial
  Chemically synthesized
gcuggaggcccuuggcgu

SEQ ID NO: 17440 - RNA, 18 nt, artificial
  Chemically synthesized
ccagagagggucccaggc

SEQ ID NO: 17441 - RNA, 18 nt, artificial
  Chemically synthesized
ggagcagcuccagguggc

SEQ ID NO: 17442 - RNA, 18 nt, artificial
  Chemically synthesized
aggcauugaaggccgaug

SEQ ID NO: 17443 - RNA, 18 nt, artificial
  Chemically synthesized
cccgcuuguaccaccugc

SEQ ID NO: 17444 - RNA, 18 nt, artificial
  Chemically synthesized
agcuccagguggcuuuug

SEQ ID NO: 17445 - RNA, 18 nt, artificial
  Chemically synthesized
cacccucagcuccaggga

SEQ ID NO: 17446 - RNA, 18 nt, artificial
  Chemically synthesized
gccaccuucugcgaggau

SEQ ID NO: 17447 - RNA, 18 nt, artificial
  Chemically synthesized
cagccuucccuacggccu

SEQ ID NO: 17448 - RNA, 18 nt, artificial
  Chemically synthesized
gcuugggcagcuccugca

SEQ ID NO: 17449 - RNA, 18 nt, artificial
  Chemically synthesized
caucuacuccuuguucag

SEQ ID NO: 17450 - RNA, 18 nt, artificial
  Chemically synthesized
gguggcugccaggagccu

SEQ ID NO: 17451 - RNA, 18 nt, artificial
  Chemically synthesized
ucaccuccaacuucgacu

SEQ ID NO: 17452 - RNA, 18 nt, artificial
  Chemically synthesized
gcaagcucugugacgacc

SEQ ID NO: 17453 - RNA, 18 nt, artificial
  Chemically synthesized
gccaugguucuccugaag

SEQ ID NO: 17454 - RNA, 18 nt, artificial
  Chemically synthesized
ggcauugaaggccgaugc

SEQ ID NO: 17455 - RNA, 18 nt, artificial
  Chemically synthesized
gcuggcugaggagaagcu

SEQ ID NO: 17456 - RNA, 18 nt, artificial
  Chemically synthesized
ccaagcagcccaccuccu

SEQ ID NO: 17457 - RNA, 18 nt, artificial
  Chemically synthesized
uucuguagaagauaccac

SEQ ID NO: 17458 - RNA, 18 nt, artificial
  Chemically synthesized
caugaugagcaaccucac

SEQ ID NO: 17459 - RNA, 18 nt, artificial
  Chemically synthesized
gcgcccgaggacaagacg

SEQ ID NO: 17460 - RNA, 18 nt, artificial
  Chemically synthesized
ggcugcacccaccugugc

SEQ ID NO: 17461 - RNA, 18 nt, artificial
  Chemically synthesized
ugcccuggcuuucagggu

SEQ ID NO: 17462 - RNA, 18 nt, artificial
  Chemically synthesized
aucaucggaacagaaauu

SEQ ID NO: 17463 - RNA, 18 nt, artificial
  Chemically synthesized
cgccacuccaacuuucug

SEQ ID NO: 17464 - RNA, 18 nt, artificial
  Chemically synthesized
gaccgcguguccuugccu

SEQ ID NO: 17465 - RNA, 18 nt, artificial
  Chemically synthesized
ccggugugggugggacau

SEQ ID NO: 17466 - RNA, 18 nt, artificial
  Chemically synthesized
uguccgggagcccuucau

SEQ ID NO: 17467 - RNA, 18 nt, artificial
  Chemically synthesized
cggaggcugcacccaccu

SEQ ID NO: 17468 - RNA, 18 nt, artificial
  Chemically synthesized
gcaccaggugaaccaagc

SEQ ID NO: 17469 - RNA, 18 nt, artificial
  Chemically synthesized
ccgagcccugcgggaaca

SEQ ID NO: 17470 - RNA, 18 nt, artificial
  Chemically synthesized
cuacccaguggagugcac

SEQ ID NO: 17471 - RNA, 18 nt, artificial
  Chemically synthesized
ggcccgaaaggccaugug

SEQ ID NO: 17472 - RNA, 18 nt, artificial
  Chemically synthesized
gccuucaccaccuccagc

SEQ ID NO: 17473 - RNA, 18 nt, artificial
  Chemically synthesized
gcacagaugguacagcug

SEQ ID NO: 17474 - RNA, 18 nt, artificial
  Chemically synthesized
gcaugccaugguucuccu

SEQ ID NO: 17475 - RNA, 18 nt, artificial
  Chemically synthesized
uucccuuccucccuggaa

SEQ ID NO: 17476 - RNA, 18 nt, artificial
  Chemically synthesized
gguucuccugaagcuggg

SEQ ID NO: 17477 - RNA, 18 nt, artificial
  Chemically synthesized
gagccaacaccuggacgg

SEQ ID NO: 17478 - RNA, 18 nt, artificial
  Chemically synthesized
gcugccucccaccauccu

SEQ ID NO: 17479 - RNA, 18 nt, artificial
  Chemically synthesized
gagcugagcugccugcag

SEQ ID NO: 17480 - RNA, 18 nt, artificial
  Chemically synthesized
aggcagaaugaccgcgug

SEQ ID NO: 17481 - RNA, 18 nt, artificial
  Chemically synthesized
cacgccagggcagacgaa

SEQ ID NO: 17482 - RNA, 18 nt, artificial
  Chemically synthesized
gaugcaggcggcggcacu

SEQ ID NO: 17483 - RNA, 18 nt, artificial
  Chemically synthesized
caccuucugcgaggauuu

SEQ ID NO: 17484 - RNA, 18 nt, artificial
  Chemically synthesized
aacuggauacgguguuua

SEQ ID NO: 17485 - RNA, 18 nt, artificial
  Chemically synthesized
cugggcgugcagaaggcg

SEQ ID NO: 17486 - RNA, 18 nt, artificial
  Chemically synthesized
ccgcuuguaccaccugcu

SEQ ID NO: 17487 - RNA, 18 nt, artificial
  Chemically synthesized
cccagcaagcucugugac

SEQ ID NO: 17488 - RNA, 18 nt, artificial
  Chemically synthesized
ugggagccacaugucauu

SEQ ID NO: 17489 - RNA, 18 nt, artificial
  Chemically synthesized
ggcagcccugccucccug

SEQ ID NO: 17490 - RNA, 18 nt, artificial
  Chemically synthesized
gguccgcgggcaacuccg

SEQ ID NO: 17491 - RNA, 18 nt, artificial
  Chemically synthesized
ucucuagaggcauugaag

SEQ ID NO: 17492 - RNA, 18 nt, artificial
  Chemically synthesized
ugaucugcuugggcagcu

SEQ ID NO: 17493 - RNA, 18 nt, artificial
  Chemically synthesized
gacuggagccaagggugc

SEQ ID NO: 17494 - RNA, 18 nt, artificial
  Chemically synthesized
uggacaguggaagaugag

SEQ ID NO: 17495 - RNA, 18 nt, artificial
  Chemically synthesized
ccaugcccuuccucagcc

SEQ ID NO: 17496 - RNA, 18 nt, artificial
  Chemically synthesized
gggcuggugcggcuggac

SEQ ID NO: 17497 - RNA, 18 nt, artificial
  Chemically synthesized
cacagccagcagccuuuc

SEQ ID NO: 17498 - RNA, 18 nt, artificial
  Chemically synthesized
gcccgaggacaagacgca

SEQ ID NO: 17499 - RNA, 18 nt, artificial
  Chemically synthesized
ucgccagacugugucauc

SEQ ID NO: 17500 - RNA, 18 nt, artificial
  Chemically synthesized
aggacaaaacgggcgcga

SEQ ID NO: 17501 - RNA, 18 nt, artificial
  Chemically synthesized
caagcucugugacgaccc

SEQ ID NO: 17502 - RNA, 18 nt, artificial
  Chemically synthesized
ggucugcccugugcccug

SEQ ID NO: 17503 - RNA, 18 nt, artificial
  Chemically synthesized
aagggugcucccugcgau

SEQ ID NO: 17504 - RNA, 18 nt, artificial
  Chemically synthesized
cauccggacgcuccaguc

SEQ ID NO: 17505 - RNA, 18 nt, artificial
  Chemically synthesized
gcaccgcagcccacaugg

SEQ ID NO: 17506 - RNA, 18 nt, artificial
  Chemically synthesized
accaggaagccguccgca

SEQ ID NO: 17507 - RNA, 18 nt, artificial
  Chemically synthesized
gcuuggugcccgagccug

SEQ ID NO: 17508 - RNA, 18 nt, artificial
  Chemically synthesized
ccugcgauccacuggcag

SEQ ID NO: 17509 - RNA, 18 nt, artificial
  Chemically synthesized
agagccaacaccuggacg

SEQ ID NO: 17510 - RNA, 18 nt, artificial
  Chemically synthesized
ggcccuuggcgugcccga

SEQ ID NO: 17511 - RNA, 18 nt, artificial
  Chemically synthesized
agccugcaccaggugaac

SEQ ID NO: 17512 - RNA, 18 nt, artificial
  Chemically synthesized
acccgagcccugcgggaa

SEQ ID NO: 17513 - RNA, 18 nt, artificial
  Chemically synthesized
ccuuuccacagucacugc

SEQ ID NO: 17514 - RNA, 18 nt, artificial
  Chemically synthesized
caguggagugcaccgagg

SEQ ID NO: 17515 - RNA, 18 nt, artificial
  Chemically synthesized
uggcuuuugggagccaca

SEQ ID NO: 17516 - RNA, 18 nt, artificial
  Chemically synthesized
cagcuucugcugccggag

SEQ ID NO: 17517 - RNA, 18 nt, artificial
  Chemically synthesized
cggaugcaggcggcggca

SEQ ID NO: 17518 - RNA, 18 nt, artificial
  Chemically synthesized
cguggacagcaccgagga

SEQ ID NO: 17519 - RNA, 18 nt, artificial
  Chemically synthesized
ucugaagcacaaacugaa

SEQ ID NO: 17520 - RNA, 18 nt, artificial
  Chemically synthesized
aggaucucucuagaggca

SEQ ID NO: 17521 - RNA, 18 nt, artificial
  Chemically synthesized
cagcaacuuggaaaucag

SEQ ID NO: 17522 - RNA, 18 nt, artificial
  Chemically synthesized
cugcaccgcagcccacau

SEQ ID NO: 17523 - RNA, 18 nt, artificial
  Chemically synthesized
ugguucuccugaagcugg

SEQ ID NO: 17524 - RNA, 18 nt, artificial
  Chemically synthesized
ggcucgaaugcccuuugg

SEQ ID NO: 17525 - RNA, 18 nt, artificial
  Chemically synthesized
cccacaggcuucaggccc

SEQ ID NO: 17526 - RNA, 18 nt, artificial
  Chemically synthesized
cuguucccuuccucccug

SEQ ID NO: 17527 - RNA, 18 nt, artificial
  Chemically synthesized
cacccuuucccacuuggc

SEQ ID NO: 17528 - RNA, 18 nt, artificial
  Chemically synthesized
ccgaggacccagaggagc

SEQ ID NO: 17529 - RNA, 18 nt, artificial
  Chemically synthesized
aagccaugaugagcaacc

SEQ ID NO: 17530 - RNA, 18 nt, artificial
  Chemically synthesized
agccguccgcacccucag

SEQ ID NO: 17531 - RNA, 18 nt, artificial
  Chemically synthesized
gacggugagcggaugcag

SEQ ID NO: 17532 - RNA, 18 nt, artificial
  Chemically synthesized
ccaggcacagauggagca

SEQ ID NO: 17533 - RNA, 18 nt, artificial
  Chemically synthesized
gcccgcuuguaccaccug

SEQ ID NO: 17534 - RNA, 18 nt, artificial
  Chemically synthesized
uuugggagccacauguca

SEQ ID NO: 17535 - RNA, 18 nt, artificial
  Chemically synthesized
cccuuccucagccugcac

SEQ ID NO: 17536 - RNA, 18 nt, artificial
  Chemically synthesized
gugcccaccuacucccac

SEQ ID NO: 17537 - RNA, 18 nt, artificial
  Chemically synthesized
gccuaccuccagagcuac

SEQ ID NO: 17538 - RNA, 18 nt, artificial
  Chemically synthesized
agaugagcuggccgccau

SEQ ID NO: 17539 - RNA, 18 nt, artificial
  Chemically synthesized
ugggcagcuccugcagaa

SEQ ID NO: 17540 - RNA, 18 nt, artificial
  Chemically synthesized
agaucuucgccaggaagg

SEQ ID NO: 17541 - RNA, 18 nt, artificial
  Chemically synthesized
agagcccagggcugcaac

SEQ ID NO: 17542 - RNA, 18 nt, artificial
  Chemically synthesized
caggcacagauggagcag

SEQ ID NO: 17543 - RNA, 18 nt, artificial
  Chemically synthesized
cagggacgaccaccggcu

SEQ ID NO: 17544 - RNA, 18 nt, artificial
  Chemically synthesized
acgcuccaguccaaucug

SEQ ID NO: 17545 - RNA, 18 nt, artificial
  Chemically synthesized
cgcuccaguccaaucugg

SEQ ID NO: 17546 - RNA, 18 nt, artificial
  Chemically synthesized
ccugaggagaugagcugg

SEQ ID NO: 17547 - RNA, 18 nt, artificial
  Chemically synthesized
uuguaucugaagcacaaa

SEQ ID NO: 17548 - RNA, 18 nt, artificial
  Chemically synthesized
uaccaccucuccaaauac

SEQ ID NO: 17549 - RNA, 18 nt, artificial
  Chemically synthesized
caaaacgggcgcgaugau

SEQ ID NO: 17550 - RNA, 18 nt, artificial
  Chemically synthesized
cgcuuguaccaccugcug

SEQ ID NO: 17551 - RNA, 18 nt, artificial
  Chemically synthesized
gccaagcagcccaccucc

SEQ ID NO: 17552 - RNA, 18 nt, artificial
  Chemically synthesized
agaacuggauacgguguu

SEQ ID NO: 17553 - RNA, 18 nt, artificial
  Chemically synthesized
gcgggacguggccuacca

SEQ ID NO: 17554 - RNA, 18 nt, artificial
  Chemically synthesized
ccucagagcccagggcug

SEQ ID NO: 17555 - RNA, 18 nt, artificial
  Chemically synthesized
cugcagaaccuggaacag

SEQ ID NO: 17556 - RNA, 18 nt, artificial
  Chemically synthesized
cacuggccucccugauac

SEQ ID NO: 17557 - RNA, 18 nt, artificial
  Chemically synthesized
agauggagcagcuccagg

SEQ ID NO: 17558 - RNA, 18 nt, artificial
  Chemically synthesized
ugaugagcaaccucacgc

SEQ ID NO: 17559 - RNA, 18 nt, artificial
  Chemically synthesized
ccgaaaggccauguggag

SEQ ID NO: 17560 - RNA, 18 nt, artificial
  Chemically synthesized
augccucuagagagaucc

SEQ ID NO: 17561 - RNA, 18 nt, artificial
  Chemically synthesized
auuggaauuguaaacacc

SEQ ID NO: 17562 - RNA, 18 nt, artificial
  Chemically synthesized
acaugugguuguucagcc

SEQ ID NO: 17563 - RNA, 18 nt, artificial
  Chemically synthesized
caccaagacccuucaccc

SEQ ID NO: 17564 - RNA, 18 nt, artificial
  Chemically synthesized
uauccaguucugaccacc

SEQ ID NO: 17565 - RNA, 18 nt, artificial
  Chemically synthesized
ucuucuacagaaaguugg

SEQ ID NO: 17566 - RNA, 18 nt, artificial
  Chemically synthesized
acuguuccagguucugca

SEQ ID NO: 17567 - RNA, 18 nt, artificial
  Chemically synthesized
acuccacuggguaguugg

SEQ ID NO: 17568 - RNA, 18 nt, artificial
  Chemically synthesized
uuccgaugaugauuccag

SEQ ID NO: 17569 - RNA, 18 nt, artificial
  Chemically synthesized
aucugggaguguucgucc

SEQ ID NO: 17570 - RNA, 18 nt, artificial
  Chemically synthesized
uaggcugcguucagugcc

SEQ ID NO: 17571 - RNA, 18 nt, artificial
  Chemically synthesized
uuuuguccuaaaugaagg

SEQ ID NO: 17572 - RNA, 18 nt, artificial
  Chemically synthesized
uguccuguuccuuccucc

SEQ ID NO: 17573 - RNA, 18 nt, artificial
  Chemically synthesized
gaaguaggaugaugaaag

SEQ ID NO: 17574 - RNA, 18 nt, artificial
  Chemically synthesized
ucuccucaggcuccuggc

SEQ ID NO: 17575 - RNA, 18 nt, artificial
  Chemically synthesized
uuggcuccaguccgaaac

SEQ ID NO: 17576 - RNA, 18 nt, artificial
  Chemically synthesized
cuucacccagaaauagag

SEQ ID NO: 17577 - RNA, 18 nt, artificial
  Chemically synthesized
auguggcucccaaaagcc

SEQ ID NO: 17578 - RNA, 18 nt, artificial
  Chemically synthesized
ugauuuccaaguugcugg

SEQ ID NO: 17579 - RNA, 18 nt, artificial
  Chemically synthesized
aucauggcuugguucacc

SEQ ID NO: 17580 - RNA, 18 nt, artificial
  Chemically synthesized
acccuuggcuccaguccg

SEQ ID NO: 17581 - RNA, 18 nt, artificial
  Chemically synthesized
uucugaccacccugaaag

SEQ ID NO: 17582 - RNA, 18 nt, artificial
  Chemically synthesized
aucuccucaggcuccugg

SEQ ID NO: 17583 - RNA, 18 nt, artificial
  Chemically synthesized
aagaccguagcaauaccc

SEQ ID NO: 17584 - RNA, 18 nt, artificial
  Chemically synthesized
gugacuguggaaaggcug

SEQ ID NO: 17585 - RNA, 18 nt, artificial
  Chemically synthesized
uaaaugaagggcucccgg

SEQ ID NO: 17586 - RNA, 18 nt, artificial
  Chemically synthesized
uagaauuucuguuccgau

SEQ ID NO: 17587 - RNA, 18 nt, artificial
  Chemically synthesized
caaaugacauguggcucc

SEQ ID NO: 17588 - RNA, 18 nt, artificial
  Chemically synthesized
aagcugaguggucuaugg

SEQ ID NO: 17589 - RNA, 18 nt, artificial
  Chemically synthesized
ccaccaagacccuucacc

SEQ ID NO: 17590 - RNA, 18 nt, artificial
  Chemically synthesized
acacgcggucauucugcc

SEQ ID NO: 17591 - RNA, 18 nt, artificial
  Chemically synthesized
aaaugacauguggcuccc

SEQ ID NO: 17592 - RNA, 18 nt, artificial
  Chemically synthesized
auuucuguuccgaugaug

SEQ ID NO: 17593 - RNA, 18 nt, artificial
  Chemically synthesized
acuguggaaaggcugcug

SEQ ID NO: 17594 - RNA, 18 nt, artificial
  Chemically synthesized
cuagaaugucgaaggcgc

SEQ ID NO: 17595 - RNA, 18 nt, artificial
  Chemically synthesized
uuggaauuguaaacaccg

SEQ ID NO: 17596 - RNA, 18 nt, artificial
  Chemically synthesized
uguuggcucuguucccgc

SEQ ID NO: 17597 - RNA, 18 nt, artificial
  Chemically synthesized
caccuagaaugucgaagg

SEQ ID NO: 17598 - RNA, 18 nt, artificial
  Chemically synthesized
augauuccagggaggaag

SEQ ID NO: 17599 - RNA, 18 nt, artificial
  Chemically synthesized
uuggaggugagaaguagg

SEQ ID NO: 17600 - RNA, 18 nt, artificial
  Chemically synthesized
aaaguuggaguggcgucu

SEQ ID NO: 17601 - RNA, 18 nt, artificial
  Chemically synthesized
uucaaugccucuagagag

SEQ ID NO: 17602 - RNA, 18 nt, artificial
  Chemically synthesized
aaagcugaguggucuaug

SEQ ID NO: 17603 - RNA, 18 nt, artificial
  Chemically synthesized
ucuggucuuugacagagc

SEQ ID NO: 17604 - RNA, 18 nt, artificial
  Chemically synthesized
auuggacuggagcguccg

SEQ ID NO: 17605 - RNA, 18 nt, artificial
  Chemically synthesized
gacagucgaaguuggagg

SEQ ID NO: 17606 - RNA, 18 nt, artificial
  Chemically synthesized
gggccuccagcuucuccc

SEQ ID NO: 17607 - RNA, 18 nt, artificial
  Chemically synthesized
ugacuguggaaaggcugc

SEQ ID NO: 17608 - RNA, 18 nt, artificial
  Chemically synthesized
acgcggucauucugccuc

SEQ ID NO: 17609 - RNA, 18 nt, artificial
  Chemically synthesized
aaggcugcuggcuguggg

SEQ ID NO: 17610 - RNA, 18 nt, artificial
  Chemically synthesized
aagggaacagggaggagg

SEQ ID NO: 17611 - RNA, 18 nt, artificial
  Chemically synthesized
ugagguugcucaucaugg

SEQ ID NO: 17612 - RNA, 18 nt, artificial
  Chemically synthesized
agaggugguaucuucuac

SEQ ID NO: 17613 - RNA, 18 nt, artificial
  Chemically synthesized
ccguauccaguucugacc

SEQ ID NO: 17614 - RNA, 18 nt, artificial
  Chemically synthesized
uuucuguuccgaugauga

SEQ ID NO: 17615 - RNA, 18 nt, artificial
  Chemically synthesized
gugggugcagccuccggc

SEQ ID NO: 17616 - RNA, 18 nt, artificial
  Chemically synthesized
gggucuucaguuugugcu

SEQ ID NO: 17617 - RNA, 18 nt, artificial
  Chemically synthesized
ucauggcuugguucaccu

SEQ ID NO: 17618 - RNA, 18 nt, artificial
  Chemically synthesized
ucccaaaugacauguggc

SEQ ID NO: 17619 - RNA, 18 nt, artificial
  Chemically synthesized
caugcaggagguccugcc

SEQ ID NO: 17620 - RNA, 18 nt, artificial
  Chemically synthesized
uggucuauggcguccugc

SEQ ID NO: 17621 - RNA, 18 nt, artificial
  Chemically synthesized
gaucugggaguguucguc

SEQ ID NO: 17622 - RNA, 18 nt, artificial
  Chemically synthesized
agguguuggcucuguucc

SEQ ID NO: 17623 - RNA, 18 nt, artificial
  Chemically synthesized
auggcuugguucaccugg

SEQ ID NO: 17624 - RNA, 18 nt, artificial
  Chemically synthesized
cucggugcacuccacugg

SEQ ID NO: 17625 - RNA, 18 nt, artificial
  Chemically synthesized
auucacuguuccagguuc

SEQ ID NO: 17626 - RNA, 18 nt, artificial
  Chemically synthesized
augaaagcugaguggucu

SEQ ID NO: 17627 - RNA, 18 nt, artificial
  Chemically synthesized
ucucugguuccacaugug

SEQ ID NO: 17628 - RNA, 18 nt, artificial
  Chemically synthesized
agcagaucagggauccgg

SEQ ID NO: 17629 - RNA, 18 nt, artificial
  Chemically synthesized
guaggaugaugaaagcug

SEQ ID NO: 17630 - RNA, 18 nt, artificial
  Chemically synthesized
cagugacuguggaaaggc

SEQ ID NO: 17631 - RNA, 18 nt, artificial
  Chemically synthesized
ugagaaguaggaugauga

SEQ ID NO: 17632 - RNA, 18 nt, artificial
  Chemically synthesized
agauuggacuggagcguc

SEQ ID NO: 17633 - RNA, 18 nt, artificial
  Chemically synthesized
ucggugcacuccacuggg

SEQ ID NO: 17634 - RNA, 18 nt, artificial
  Chemically synthesized
auggcaugcaggaggucc

SEQ ID NO: 17635 - RNA, 18 nt, artificial
  Chemically synthesized
auuguaaacaccguaucc

SEQ ID NO: 17636 - RNA, 18 nt, artificial
  Chemically synthesized
acggcuugguauuuggag

SEQ ID NO: 17637 - RNA, 18 nt, artificial
  Chemically synthesized
cucaucauggcuugguuc

SEQ ID NO: 17638 - RNA, 18 nt, artificial
  Chemically synthesized
cucaucuccucaggcucc

SEQ ID NO: 17639 - RNA, 18 nt, artificial
  Chemically synthesized
gcuccaguccgaaacacc

SEQ ID NO: 17640 - RNA, 18 nt, artificial
  Chemically synthesized
uuccuuccuccacauggc

SEQ ID NO: 17641 - RNA, 18 nt, artificial
  Chemically synthesized
ucuguucccgcagggcuc

SEQ ID NO: 17642 - RNA, 18 nt, artificial
  Chemically synthesized
uucacuguuccagguucu

SEQ ID NO: 17643 - RNA, 18 nt, artificial
  Chemically synthesized
agcuucucccgaacccgc

SEQ ID NO: 17644 - RNA, 18 nt, artificial
  Chemically synthesized
aauccucgcagaaggugg

SEQ ID NO: 17645 - RNA, 18 nt, artificial
  Chemically synthesized
cuguggaaaggcugcugg

SEQ ID NO: 17646 - RNA, 18 nt, artificial
  Chemically synthesized
augacacagucuggcgac

SEQ ID NO: 17647 - RNA, 18 nt, artificial
  Chemically synthesized
gaugaugaaagcugagug

SEQ ID NO: 17648 - RNA, 18 nt, artificial
  Chemically synthesized
aucgcgcccguuuugucc

SEQ ID NO: 17649 - RNA, 18 nt, artificial
  Chemically synthesized
ccagaaauagagagauug

SEQ ID NO: 17650 - RNA, 18 nt, artificial
  Chemically synthesized
uagaaugucgaaggcgcu

SEQ ID NO: 17651 - RNA, 18 nt, artificial
  Chemically synthesized
cgauguguucgucugccc

SEQ ID NO: 17652 - RNA, 18 nt, artificial
  Chemically synthesized
ugcccaagcagaucaggg

SEQ ID NO: 17653 - RNA, 18 nt, artificial
  Chemically synthesized
agauacaagagcuugucc

SEQ ID NO: 17654 - RNA, 18 nt, artificial
  Chemically synthesized
gauacaagagcuuguccu

SEQ ID NO: 17655 - RNA, 18 nt, artificial
  Chemically synthesized
agcugaguggucuauggc

SEQ ID NO: 17656 - RNA, 18 nt, artificial
  Chemically synthesized
agugacuguggaaaggcu

SEQ ID NO: 17657 - RNA, 18 nt, artificial
  Chemically synthesized
cacccuuggcuccagucc

SEQ ID NO: 17658 - RNA, 18 nt, artificial
  Chemically synthesized
augaugaaagcugagugg

SEQ ID NO: 17659 - RNA, 18 nt, artificial
  Chemically synthesized
auucugccuccugcgucu

SEQ ID NO: 17660 - RNA, 18 nt, artificial
  Chemically synthesized
agggcgcuggcuccaccc

SEQ ID NO: 17661 - RNA, 18 nt, artificial
  Chemically synthesized
uugguauuuggagaggug

SEQ ID NO: 17662 - RNA, 18 nt, artificial
  Chemically synthesized
aguaggcugcguucagug

SEQ ID NO: 17663 - RNA, 18 nt, artificial
  Chemically synthesized
gaaguuggaggugagaag

SEQ ID NO: 17664 - RNA, 18 nt, artificial
  Chemically synthesized
ucuagagagauccuggcc

SEQ ID NO: 17665 - RNA, 18 nt, artificial
  Chemically synthesized
ucuauggcguccugcagg

SEQ ID NO: 17666 - RNA, 18 nt, artificial
  Chemically synthesized
agaaauagagagauugga

SEQ ID NO: 17667 - RNA, 18 nt, artificial
  Chemically synthesized
uuggaguggcgucugguc

SEQ ID NO: 17668 - RNA, 18 nt, artificial
  Chemically synthesized
uggcgucuggucuuugac

SEQ ID NO: 17669 - RNA, 18 nt, artificial
  Chemically synthesized
gcgucuggucuuugacag

SEQ ID NO: 17670 - RNA, 18 nt, artificial
  Chemically synthesized
gcauguuccacacugccc

SEQ ID NO: 17671 - RNA, 18 nt, artificial
  Chemically synthesized
cagcuucucccgaacccg

SEQ ID NO: 17672 - RNA, 18 nt, artificial
  Chemically synthesized
ccugcugcaccuagaaug

SEQ ID NO: 17673 - RNA, 18 nt, artificial
  Chemically synthesized
cuacccauucacuguucc

SEQ ID NO: 17674 - RNA, 18 nt, artificial
  Chemically synthesized
aaggcauguuccacacug

SEQ ID NO: 17675 - RNA, 18 nt, artificial
  Chemically synthesized
uguggaaaggcugcuggc

SEQ ID NO: 17676 - RNA, 18 nt, artificial
  Chemically synthesized
gagauuggaauuguaaac

SEQ ID NO: 17677 - RNA, 18 nt, artificial
  Chemically synthesized
caugugguuguucagccc

SEQ ID NO: 17678 - RNA, 18 nt, artificial
  Chemically synthesized
gcuucaggagaaccaugg

SEQ ID NO: 17679 - RNA, 18 nt, artificial
  Chemically synthesized
ugaccucaucuuccacug

SEQ ID NO: 17680 - RNA, 18 nt, artificial
  Chemically synthesized
uggaaaggcugcuggcug

SEQ ID NO: 17681 - RNA, 18 nt, artificial
  Chemically synthesized
uucuccucagccagcagg

SEQ ID NO: 17682 - RNA, 18 nt, artificial
  Chemically synthesized
caauguccugaaaguggc

SEQ ID NO: 17683 - RNA, 18 nt, artificial
  Chemically synthesized
gguucugcaggagcugcc

SEQ ID NO: 17684 - RNA, 18 nt, artificial
  Chemically synthesized
aaugucccacccacaccg

SEQ ID NO: 17685 - RNA, 18 nt, artificial
  Chemically synthesized
auagagagauuggaauug

SEQ ID NO: 17686 - RNA, 18 nt, artificial
  Chemically synthesized
aucuuccacuguccacag

SEQ ID NO: 17687 - RNA, 18 nt, artificial
  Chemically synthesized
cucuagagagauccuggc

SEQ ID NO: 17688 - RNA, 18 nt, artificial
  Chemically synthesized
gcucaucuccucaggcuc

SEQ ID NO: 17689 - RNA, 18 nt, artificial
  Chemically synthesized
ugcuguccacgccagccc

SEQ ID NO: 17690 - RNA, 18 nt, artificial
  Chemically synthesized
agcucaucuccucaggcu

SEQ ID NO: 17691 - RNA, 18 nt, artificial
  Chemically synthesized
cccauucacuguuccagg

SEQ ID NO: 17692 - RNA, 18 nt, artificial
  Chemically synthesized
aaugucgaaggcgcuagg

SEQ ID NO: 17693 - RNA, 18 nt, artificial
  Chemically synthesized
aaugaagggcucccggac

SEQ ID NO: 17694 - RNA, 18 nt, artificial
  Chemically synthesized
gacccuucacccagaaau

SEQ ID NO: 17695 - RNA, 18 nt, artificial
  Chemically synthesized
cgugguggauaaugaggg

SEQ ID NO: 17696 - RNA, 18 nt, artificial
  Chemically synthesized
cuucugcggaguugcccg

SEQ ID NO: 17697 - RNA, 18 nt, artificial
  Chemically synthesized
uccacuggguaguuggug

SEQ ID NO: 17698 - RNA, 18 nt, artificial
  Chemically synthesized
guggugaaggcauguucc

SEQ ID NO: 17699 - RNA, 18 nt, artificial
  Chemically synthesized
uguuggccaccuuccugg

SEQ ID NO: 17700 - RNA, 18 nt, artificial
  Chemically synthesized
acgccagcccacuggcgg

SEQ ID NO: 17701 - RNA, 18 nt, artificial
  Chemically synthesized
caaagccgaggauggugg

SEQ ID NO: 17702 - RNA, 18 nt, artificial
  Chemically synthesized
cuaaaugaagggcucccg

SEQ ID NO: 17703 - RNA, 18 nt, artificial
  Chemically synthesized
ucgcagggagcacccuug

SEQ ID NO: 17704 - RNA, 18 nt, artificial
  Chemically synthesized
uguguucgucugcccugg

SEQ ID NO: 17705 - RNA, 18 nt, artificial
  Chemically synthesized
agccgaggauggugggag

SEQ ID NO: 17706 - RNA, 18 nt, artificial
  Chemically synthesized
ccuggugcaggcucaggc

SEQ ID NO: 17707 - RNA, 18 nt, artificial
  Chemically synthesized
cagggagcacccuuggcu

SEQ ID NO: 17708 - RNA, 18 nt, artificial
  Chemically synthesized
guucugcaggagcugccc

SEQ ID NO: 17709 - RNA, 18 nt, artificial
  Chemically synthesized
aguggucuauggcguccu

SEQ ID NO: 17710 - RNA, 18 nt, artificial
  Chemically synthesized
uagagagauuggaauugu

SEQ ID NO: 17711 - RNA, 18 nt, artificial
  Chemically synthesized
uucucccgaacccgcagg

SEQ ID NO: 17712 - RNA, 18 nt, artificial
  Chemically synthesized
aguggagguugcaucugg

SEQ ID NO: 17713 - RNA, 18 nt, artificial
  Chemically synthesized
augaccucaucuuccacu

SEQ ID NO: 17714 - RNA, 18 nt, artificial
  Chemically synthesized
uuggcucuguucccgcag

SEQ ID NO: 17715 - RNA, 18 nt, artificial
  Chemically synthesized
guuggugcugguuucugg

SEQ ID NO: 17716 - RNA, 18 nt, artificial
  Chemically synthesized
uuuggagaggugguaucu

SEQ ID NO: 17717 - RNA, 18 nt, artificial
  Chemically synthesized
aucugugccugguaggac

SEQ ID NO: 17718 - RNA, 18 nt, artificial
  Chemically synthesized
uggcucccaaaagccacc

SEQ ID NO: 17719 - RNA, 18 nt, artificial
  Chemically synthesized
aauuguaaacaccguauc

SEQ ID NO: 17720 - RNA, 18 nt, artificial
  Chemically synthesized
acaauguccugaaagugg

SEQ ID NO: 17721 - RNA, 18 nt, artificial
  Chemically synthesized
ccucuagagagauccugg

SEQ ID NO: 17722 - RNA, 18 nt, artificial
  Chemically synthesized
gcgauguguucgucugcc

SEQ ID NO: 17723 - RNA, 18 nt, artificial
  Chemically synthesized
ugaacaaggaguagauga

SEQ ID NO: 17724 - RNA, 18 nt, artificial
  Chemically synthesized
agcccaggacacaucugg

SEQ ID NO: 17725 - RNA, 18 nt, artificial
  Chemically synthesized
aagaucugggaguguucg

SEQ ID NO: 17726 - RNA, 18 nt, artificial
  Chemically synthesized
gaggugguaucuucuaca

SEQ ID NO: 17727 - RNA, 18 nt, artificial
  Chemically synthesized
aggaucacaaaguuauag

SEQ ID NO: 17728 - RNA, 18 nt, artificial
  Chemically synthesized
gucccagagggcaaagcc

SEQ ID NO: 17729 - RNA, 18 nt, artificial
  Chemically synthesized
gggcuucugcggaguugc

SEQ ID NO: 17730 - RNA, 18 nt, artificial
  Chemically synthesized
agguguuggccaccuucc

SEQ ID NO: 17731 - RNA, 18 nt, artificial
  Chemically synthesized
ccaccaccaagacccuuc

SEQ ID NO: 17732 - RNA, 18 nt, artificial
  Chemically synthesized
uguuccgaugaugauucc

SEQ ID NO: 17733 - RNA, 18 nt, artificial
  Chemically synthesized
uugcugggcccauguggg

SEQ ID NO: 17734 - RNA, 18 nt, artificial
  Chemically synthesized
gauuggacuggagcgucc

SEQ ID NO: 17735 - RNA, 18 nt, artificial
  Chemically synthesized
aaguuggaguggcgucug

SEQ ID NO: 17736 - RNA, 18 nt, artificial
  Chemically synthesized
agcccugggcucugaggg

SEQ ID NO: 17737 - RNA, 18 nt, artificial
  Chemically synthesized
ugaguggucuauggcguc

SEQ ID NO: 17738 - RNA, 18 nt, artificial
  Chemically synthesized
gaguguucguccagccgc

SEQ ID NO: 17739 - RNA, 18 nt, artificial
  Chemically synthesized
gcuucugcggaguugccc

SEQ ID NO: 17740 - RNA, 18 nt, artificial
  Chemically synthesized
agugggaaaggguggcgg

SEQ ID NO: 17741 - RNA, 18 nt, artificial
  Chemically synthesized
gaggugagaaguaggaug

SEQ ID NO: 17742 - RNA, 18 nt, artificial
  Chemically synthesized
uguucguccagccgcacc

SEQ ID NO: 17743 - RNA, 18 nt, artificial
  Chemically synthesized
gccaguggagguugcauc

SEQ ID NO: 17744 - RNA, 18 nt, artificial
  Chemically synthesized
ucaucuuccacuguccac

SEQ ID NO: 17745 - RNA, 18 nt, artificial
  Chemically synthesized
ggaucacaaaguuauaga

SEQ ID NO: 17746 - RNA, 18 nt, artificial
  Chemically synthesized
ugcuucagauacaagagc

SEQ ID NO: 17747 - RNA, 18 nt, artificial
  Chemically synthesized
gugggaggcuccuggucc

SEQ ID NO: 17748 - RNA, 18 nt, artificial
  Chemically synthesized
acggcuuccugguaggcc

SEQ ID NO: 17749 - RNA, 18 nt, artificial
  Chemically synthesized
acccagaaauagagagau

SEQ ID NO: 17750 - RNA, 18 nt, artificial
  Chemically synthesized
uuccacuguccacagggc

SEQ ID NO: 17751 - RNA, 18 nt, artificial
  Chemically synthesized
cucuguucccgcagggcu

SEQ ID NO: 17752 - RNA, 18 nt, artificial
  Chemically synthesized
ucugguuccacauguggu

SEQ ID NO: 17753 - RNA, 18 nt, artificial
  Chemically synthesized
gggcuugaagguguuggc

SEQ ID NO: 17754 - RNA, 18 nt, artificial
  Chemically synthesized
aguuugugcuucagauac

SEQ ID NO: 17755 - RNA, 18 nt, artificial
  Chemically synthesized
aaguaggaugaugaaagc

SEQ ID NO: 17756 - RNA, 18 nt, artificial
  Chemically synthesized
cgccugggacccucucug

SEQ ID NO: 17757 - RNA, 18 nt, artificial
  Chemically synthesized
gggaugacacagucuggc

SEQ ID NO: 17758 - RNA, 18 nt, artificial
  Chemically synthesized
ugcaggcugaggaagggc

SEQ ID NO: 17759 - RNA, 18 nt, artificial
  Chemically synthesized
gacacgcggucauucugc

SEQ ID NO: 17760 - RNA, 18 nt, artificial
  Chemically synthesized
gccucauccugaaguucc

SEQ ID NO: 17761 - RNA, 18 nt, artificial
  Chemically synthesized
cagaaauagagagauugg

SEQ ID NO: 17762 - RNA, 18 nt, artificial
  Chemically synthesized
uggaucgcagggagcacc

SEQ ID NO: 17763 - RNA, 18 nt, artificial
  Chemically synthesized
gguguuggcucuguuccc

SEQ ID NO: 17764 - RNA, 18 nt, artificial
  Chemically synthesized
aaagccaccuggagcugc

SEQ ID NO: 17765 - RNA, 18 nt, artificial
  Chemically synthesized
aaggcgcuaggaagugau

SEQ ID NO: 17766 - RNA, 18 nt, artificial
  Chemically synthesized
ucuuccacuguccacagg

SEQ ID NO: 17767 - RNA, 18 nt, artificial
  Chemically synthesized
ucaucuccucaggcuccu

SEQ ID NO: 17768 - RNA, 18 nt, artificial
  Chemically synthesized
gucauucugccuccugcg

SEQ ID NO: 17769 - RNA, 18 nt, artificial
  Chemically synthesized
auguguucgucugcccug

SEQ ID NO: 17770 - RNA, 18 nt, artificial
  Chemically synthesized
ugaggaagggcaugguag

SEQ ID NO: 17771 - RNA, 18 nt, artificial
  Chemically synthesized
acuggagcguccggaugc

SEQ ID NO: 17772 - RNA, 18 nt, artificial
  Chemically synthesized
uaauuaaaagaccguagc

SEQ ID NO: 17773 - RNA, 18 nt, artificial
  Chemically synthesized
ggguguccuguuccuucc

SEQ ID NO: 17774 - RNA, 18 nt, artificial
  Chemically synthesized
cacagcuucuccucagcc

SEQ ID NO: 17775 - RNA, 18 nt, artificial
  Chemically synthesized
gacccucucugguuccac

SEQ ID NO: 17776 - RNA, 18 nt, artificial
  Chemically synthesized
gaaugucgaaggcgcuag

SEQ ID NO: 17777 - RNA, 18 nt, artificial
  Chemically synthesized
cagcucaucuccucaggc

SEQ ID NO: 17778 - RNA, 18 nt, artificial
  Chemically synthesized
aaaguggcagaugaccuc

SEQ ID NO: 17779 - RNA, 18 nt, artificial
  Chemically synthesized
uccgaaacaccgucaaug

SEQ ID NO: 17780 - RNA, 18 nt, artificial
  Chemically synthesized
uguccacagggcacaggg

SEQ ID NO: 17781 - RNA, 18 nt, artificial
  Chemically synthesized
uucuacagaaaguuggag

SEQ ID NO: 17782 - RNA, 18 nt, artificial
  Chemically synthesized
uccagcuucucccgaacc

SEQ ID NO: 17783 - RNA, 18 nt, artificial
  Chemically synthesized
aaguuggaggugagaagu

SEQ ID NO: 17784 - RNA, 18 nt, artificial
  Chemically synthesized
caaugucccacccacacc

SEQ ID NO: 17785 - RNA, 18 nt, artificial
  Chemically synthesized
ucgucacagagcuugcug

SEQ ID NO: 17786 - RNA, 18 nt, artificial
  Chemically synthesized
uucagauacaagagcuug

SEQ ID NO: 17787 - RNA, 18 nt, artificial
  Chemically synthesized
gcgcuaggaagugauggg

SEQ ID NO: 17788 - RNA, 18 nt, artificial
  Chemically synthesized
uacccauucacuguucca

SEQ ID NO: 17789 - RNA, 18 nt, artificial
  Chemically synthesized
cucccaaaagccaccugg

SEQ ID NO: 17790 - RNA, 18 nt, artificial
  Chemically synthesized
guuuuguccuaaaugaag

SEQ ID NO: 17791 - RNA, 18 nt, artificial
  Chemically synthesized
accucaucuuccacuguc

SEQ ID NO: 17792 - RNA, 18 nt, artificial
  Chemically synthesized
gauuggaauuguaaacac

SEQ ID NO: 17793 - RNA, 18 nt, artificial
  Chemically synthesized
ccucaucuuccacugucc

SEQ ID NO: 17794 - RNA, 18 nt, artificial
  Chemically synthesized
uaucagggaggccagugg

SEQ ID NO: 17795 - RNA, 18 nt, artificial
  Chemically synthesized
cagcuucuccucagccag

SEQ ID NO: 17796 - RNA, 18 nt, artificial
  Chemically synthesized
ggucauucugccuccugc

SEQ ID NO: 17797 - RNA, 18 nt, artificial
  Chemically synthesized
cugguaggacaaguagcu

SEQ ID NO: 17798 - RNA, 18 nt, artificial
  Chemically synthesized
augcaggagguccugccc

SEQ ID NO: 17799 - RNA, 18 nt, artificial
  Chemically synthesized
aaaggcugcuggcugugg

SEQ ID NO: 17800 - RNA, 18 nt, artificial
  Chemically synthesized
guuggaggugagaaguag

SEQ ID NO: 17801 - RNA, 18 nt, artificial
  Chemically synthesized
agggagcacccuuggcuc

SEQ ID NO: 17802 - RNA, 18 nt, artificial
  Chemically synthesized
uuggacuggagcguccgg

SEQ ID NO: 17803 - RNA, 18 nt, artificial
  Chemically synthesized
uagcucuggagguaggcu

SEQ ID NO: 17804 - RNA, 18 nt, artificial
  Chemically synthesized
ugaguaggcugcguucag

SEQ ID NO: 17805 - RNA, 18 nt, artificial
  Chemically synthesized
gagguaggcugaguaggc

SEQ ID NO: 17806 - RNA, 18 nt, artificial
  Chemically synthesized
gaugaugauuccagggag

SEQ ID NO: 17807 - RNA, 18 nt, artificial
  Chemically synthesized
ugaaaguggcagaugacc

SEQ ID NO: 17808 - RNA, 18 nt, artificial
  Chemically synthesized
ccgcaucggccuucaaug

SEQ ID NO: 17809 - RNA, 18 nt, artificial
  Chemically synthesized
gucccaaaugacaugugg

SEQ ID NO: 17810 - RNA, 18 nt, artificial
  Chemically synthesized
uggcuugguucaccuggu

SEQ ID NO: 17811 - RNA, 18 nt, artificial
  Chemically synthesized
cagaugaccucaucuucc

SEQ ID NO: 17812 - RNA, 18 nt, artificial
  Chemically synthesized
uucaccuggugcaggcuc

SEQ ID NO: 17813 - RNA, 18 nt, artificial
  Chemically synthesized
ugacacagucuggcgacc

SEQ ID NO: 17814 - RNA, 18 nt, artificial
  Chemically synthesized
ucugugccugguaggaca

SEQ ID NO: 17815 - RNA, 18 nt, artificial
  Chemically synthesized
uauuuggagaggugguau

SEQ ID NO: 17816 - RNA, 18 nt, artificial
  Chemically synthesized
agaaccauggcaugcagg

SEQ ID NO: 17817 - RNA, 18 nt, artificial
  Chemically synthesized
cggcugcgccacuggguc

SEQ ID NO: 17818 - RNA, 18 nt, artificial
  Chemically synthesized
uccuaaaugaagggcucc

SEQ ID NO: 17819 - RNA, 18 nt, artificial
  Chemically synthesized
agucccaaaugacaugug

SEQ ID NO: 17820 - RNA, 18 nt, artificial
  Chemically synthesized
gucuuugacagagcaggg

SEQ ID NO: 17821 - RNA, 18 nt, artificial
  Chemically synthesized
ucaucauggcuugguuca

SEQ ID NO: 17822 - RNA, 18 nt, artificial
  Chemically synthesized
cauguggcucccaaaagc

SEQ ID NO: 17823 - RNA, 18 nt, artificial
  Chemically synthesized
ugccggcugcgccacugg

SEQ ID NO: 17824 - RNA, 18 nt, artificial
  Chemically synthesized
aagccaccuggagcugcu

SEQ ID NO: 17825 - RNA, 18 nt, artificial
  Chemically synthesized
gacuggcugauuuccaag

SEQ ID NO: 17826 - RNA, 18 nt, artificial
  Chemically synthesized
cucggugcuguccacgcc

SEQ ID NO: 17827 - RNA, 18 nt, artificial
  Chemically synthesized
augaugauuccagggagg

SEQ ID NO: 17828 - RNA, 18 nt, artificial
  Chemically synthesized
ccaagacccuucacccag

SEQ ID NO: 17829 - RNA, 18 nt, artificial
  Chemically synthesized
caggcucaggcgacaguc

SEQ ID NO: 17830 - RNA, 18 nt, artificial
  Chemically synthesized
agguugcucaucauggcu

SEQ ID NO: 17831 - RNA, 18 nt, artificial
  Chemically synthesized
aaagccagggcaucaucg

SEQ ID NO: 17832 - RNA, 18 nt, artificial
  Chemically synthesized
aagccagggcaucaucgc

SEQ ID NO: 17833 - RNA, 18 nt, artificial
  Chemically synthesized
gugcggacggcuuccugg

SEQ ID NO: 17834 - RNA, 18 nt, artificial
  Chemically synthesized
cugaguggucuauggcgu

SEQ ID NO: 17835 - RNA, 18 nt, artificial
  Chemically synthesized
ugaccacccugaaagcca

SEQ ID NO: 17836 - RNA, 18 nt, artificial
  Chemically synthesized
cucaggcgacagucgaag

SEQ ID NO: 17837 - RNA, 18 nt, artificial
  Chemically synthesized
uguuccagguucugcagg

SEQ ID NO: 17838 - RNA, 18 nt, artificial
  Chemically synthesized
gugggcuggcaaucuccc

SEQ ID NO: 17839 - RNA, 18 nt, artificial
  Chemically synthesized
guugcucaucauggcuug

SEQ ID NO: 17840 - RNA, 18 nt, artificial
  Chemically synthesized
uugcucaucauggcuugg

SEQ ID NO: 17841 - RNA, 18 nt, artificial
  Chemically synthesized
cacccugaaagccagggc

SEQ ID NO: 17842 - RNA, 18 nt, artificial
  Chemically synthesized
aagggcucccggacaaug

SEQ ID NO: 17843 - RNA, 18 nt, artificial
  Chemically synthesized
gauguguucgucugcccu

SEQ ID NO: 17844 - RNA, 18 nt, artificial
  Chemically synthesized
guguuggcucuguucccg

SEQ ID NO: 17845 - RNA, 18 nt, artificial
  Chemically synthesized
aagugggaaaggguggcg

SEQ ID NO: 17846 - RNA, 18 nt, artificial
  Chemically synthesized
uggcggccagcucaucuc

SEQ ID NO: 17847 - RNA, 18 nt, artificial
  Chemically synthesized
cuccaguccgaaacaccg

SEQ ID NO: 17848 - RNA, 18 nt, artificial
  Chemically synthesized
uucagugccgccgccugc

SEQ ID NO: 17849 - RNA, 18 nt, artificial
  Chemically synthesized
aguuggaguggcgucugg

SEQ ID NO: 17850 - RNA, 18 nt, artificial
  Chemically synthesized
agcugaacaaggaguaga

SEQ ID NO: 17851 - RNA, 18 nt, artificial
  Chemically synthesized
aaugccucuagagagauc

SEQ ID NO: 17852 - RNA, 18 nt, artificial
  Chemically synthesized
uuguaaacaccguaucca

SEQ ID NO: 17853 - RNA, 18 nt, artificial
  Chemically synthesized
ugauuccagggaggaagg

SEQ ID NO: 17854 - RNA, 18 nt, artificial
  Chemically synthesized
ugggaguguucguccagc

SEQ ID NO: 17855 - RNA, 18 nt, artificial
  Chemically synthesized
uucacccagaaauagaga

SEQ ID NO: 17856 - RNA, 18 nt, artificial
  Chemically synthesized
aggcauguuccacacugc

SEQ ID NO: 17857 - RNA, 18 nt, artificial
  Chemically synthesized
ccuucacccagaaauaga

SEQ ID NO: 17858 - RNA, 18 nt, artificial
  Chemically synthesized
agcuucaggagaaccaug

SEQ ID NO: 17859 - RNA, 18 nt, artificial
  Chemically synthesized
uccacgccagcccacugg

SEQ ID NO: 17860 - RNA, 18 nt, artificial
  Chemically synthesized
gaaauagagagauuggaa

SEQ ID NO: 17861 - RNA, 18 nt, artificial
  Chemically synthesized
agcugcuccaucugugcc

SEQ ID NO: 17862 - RNA, 18 nt, artificial
  Chemically synthesized
guggagguugcaucuggg

SEQ ID NO: 17863 - RNA, 18 nt, artificial
  Chemically synthesized
gguggugaaggcauguuc

SEQ ID NO: 17864 - RNA, 18 nt, artificial
  Chemically synthesized
cacaugugguuguucagc

SEQ ID NO: 17865 - RNA, 18 nt, artificial
  Chemically synthesized
gcuaggaagugaugggcc

SEQ ID NO: 17866 - RNA, 18 nt, artificial
  Chemically synthesized
accauggcaugcaggagg

SEQ ID NO: 17867 - RNA, 18 nt, artificial
  Chemically synthesized
gugccgccgccugcaucc

SEQ ID NO: 17868 - RNA, 18 nt, artificial
  Chemically synthesized
cgcggucauucugccucc

SEQ ID NO: 17869 - RNA, 18 nt, artificial
  Chemically synthesized
uacaagagcuuguccugg

SEQ ID NO: 17870 - RNA, 18 nt, artificial
  Chemically synthesized
uugguucaccuggugcag

SEQ ID NO: 17871 - RNA, 18 nt, artificial
  Chemically synthesized
gugagaaguaggaugaug

SEQ ID NO: 17872 - RNA, 18 nt, artificial
  Chemically synthesized
ggaugacacagucuggcg

SEQ ID NO: 17873 - RNA, 18 nt, artificial
  Chemically synthesized
aaagaccguagcaauacc

SEQ ID NO: 17874 - RNA, 18 nt, artificial
  Chemically synthesized
ugcacuccacuggguagu

SEQ ID NO: 17875 - RNA, 18 nt, artificial
  Chemically synthesized
uucugcggaguugcccgc

SEQ ID NO: 17876 - RNA, 18 nt, artificial
  Chemically synthesized
agggcgauguguucgucu

SEQ ID NO: 17877 - RNA, 18 nt, artificial
  Chemically synthesized
ugcguucagugccgccgc

SEQ ID NO: 17878 - RNA, 18 nt, artificial
  Chemically synthesized
uaccaucugugcguggug

SEQ ID NO: 17879 - RNA, 18 nt, artificial
  Chemically synthesized
aggacacgcggucauucu

SEQ ID NO: 17880 - RNA, 18 nt, artificial
  Chemically synthesized
agggaggaagggaacagg

SEQ ID NO: 17881 - RNA, 18 nt, artificial
  Chemically synthesized
agaucugggaguguucgu

SEQ ID NO: 17882 - RNA, 18 nt, artificial
  Chemically synthesized
ccuucaaugccucuagag

SEQ ID NO: 17883 - RNA, 18 nt, artificial
  Chemically synthesized
ccuccugcgucuuguccu

SEQ ID NO: 17884 - RNA, 18 nt, artificial
  Chemically synthesized
caagcagaucagggaucc

SEQ ID NO: 17885 - RNA, 18 nt, artificial
  Chemically synthesized
ccaaaugacauguggcuc

SEQ ID NO: 17886 - RNA, 18 nt, artificial
  Chemically synthesized
uccacauggccuuucggg

SEQ ID NO: 17887 - RNA, 18 nt, artificial
  Chemically synthesized
aggcgacagucgaaguug

SEQ ID NO: 17888 - RNA, 18 nt, artificial
  Chemically synthesized
ugcaggcagcucagcucc

SEQ ID NO: 17889 - RNA, 18 nt, artificial
  Chemically synthesized
cugcguucagugccgccg

SEQ ID NO: 17890 - RNA, 18 nt, artificial
  Chemically synthesized
ugccuccugcgucuuguc

SEQ ID NO: 17891 - RNA, 18 nt, artificial
  Chemically synthesized
acuggcugauuuccaagu

SEQ ID NO: 17892 - RNA, 18 nt, artificial
  Chemically synthesized
gagcguccggaugcuccc

SEQ ID NO: 17893 - RNA, 18 nt, artificial
  Chemically synthesized
accguauccaguucugac

SEQ ID NO: 17894 - RNA, 18 nt, artificial
  Chemically synthesized
acuggcgggccaccagcc

SEQ ID NO: 17895 - RNA, 18 nt, artificial
  Chemically synthesized
auccgcucaccguccagg

SEQ ID NO: 17896 - RNA, 18 nt, artificial
  Chemically synthesized
ccggcuccagaauaggca

SEQ ID NO: 17897 - RNA, 18 nt, artificial
  Chemically synthesized
ugugggcugcggugcagg

SEQ ID NO: 17898 - RNA, 18 nt, artificial
  Chemically synthesized
ucggagcugagcugggcc

SEQ ID NO: 17899 - RNA, 18 nt, artificial
  Chemically synthesized
uuccugguaggccacguc

SEQ ID NO: 17900 - RNA, 18 nt, artificial
  Chemically synthesized
uguucgucugcccuggcg

SEQ ID NO: 17901 - RNA, 18 nt, artificial
  Chemically synthesized
gcacggcuugguauuugg

SEQ ID NO: 17902 - RNA, 18 nt, artificial
  Chemically synthesized
agcuguaccaucugugcg

SEQ ID NO: 17903 - RNA, 18 nt, artificial
  Chemically synthesized
gguggucgucccuggagc

SEQ ID NO: 17904 - RNA, 18 nt, artificial
  Chemically synthesized
ucaggugagcugaacaag

SEQ ID NO: 17905 - RNA, 18 nt, artificial
  Chemically synthesized
uuccuggcgaagaucugg

SEQ ID NO: 17906 - RNA, 18 nt, artificial
  Chemically synthesized
uggucuuugacagagcag

SEQ ID NO: 17907 - RNA, 18 nt, artificial
  Chemically synthesized
gaagggcagugacugugg

SEQ ID NO: 17908 - RNA, 18 nt, artificial
  Chemically synthesized
uagagagauccuggccuc

SEQ ID NO: 17909 - RNA, 18 nt, artificial
  Chemically synthesized
ggcucccggacaaugucc

SEQ ID NO: 17910 - RNA, 18 nt, artificial
  Chemically synthesized
ucccgaacccgcagggcg

SEQ ID NO: 17911 - RNA, 18 nt, artificial
  Chemically synthesized
uccucaggcuccuggcag

SEQ ID NO: 17912 - RNA, 18 nt, artificial
  Chemically synthesized
auggugggaggcagccca

SEQ ID NO: 17913 - RNA, 18 nt, artificial
  Chemically synthesized
gguggugggaguaggugg

SEQ ID NO: 17914 - RNA, 18 nt, artificial
  Chemically synthesized
gugcuguccacgccagcc

SEQ ID NO: 17915 - RNA, 18 nt, artificial
  Chemically synthesized
auacaagagcuuguccug

SEQ ID NO: 17916 - RNA, 18 nt, artificial
  Chemically synthesized
ucugggaguguucgucca

SEQ ID NO: 17917 - RNA, 18 nt, artificial
  Chemically synthesized
ccagcuguaccaucugug

SEQ ID NO: 17918 - RNA, 18 nt, artificial
  Chemically synthesized
aguggcgucuggucuuug

SEQ ID NO: 17919 - RNA, 18 nt, artificial
  Chemically synthesized
aguaggaugaugaaagcu

SEQ ID NO: 17920 - RNA, 18 nt, artificial
  Chemically synthesized
gcugaguggucuauggcg

SEQ ID NO: 17921 - RNA, 18 nt, artificial
  Chemically synthesized
gauggugggaggcagccc

SEQ ID NO: 17922 - RNA, 18 nt, artificial
  Chemically synthesized
uuccacaugugguuguuc

SEQ ID NO: 17923 - RNA, 18 nt, artificial
  Chemically synthesized
uaggaugaugaaagcuga

SEQ ID NO: 17924 - RNA, 18 nt, artificial
  Chemically synthesized
agcuggagguggugaagg

SEQ ID NO: 17925 - RNA, 18 nt, artificial
  Chemically synthesized
cgcuaggaagugaugggc

SEQ ID NO: 17926 - RNA, 18 nt, artificial
  Chemically synthesized
agcagaagcuggaggugg

SEQ ID NO: 17927 - RNA, 18 nt, artificial
  Chemically synthesized
uucugcacgcccaguguc

SEQ ID NO: 17928 - RNA, 18 nt, artificial
  Chemically synthesized
ugcauccgcucaccgucc

SEQ ID NO: 17929 - RNA, 18 nt, artificial
  Chemically synthesized
uaggcugaguaggcugcg

SEQ ID NO: 17930 - RNA, 18 nt, artificial
  Chemically synthesized
caaagggcauucgagccc

SEQ ID NO: 17931 - RNA, 18 nt, artificial
  Chemically synthesized
uggugggcuggcaaucuc

SEQ ID NO: 17932 - RNA, 18 nt, artificial
  Chemically synthesized
gucuucaguuugugcuuc

SEQ ID NO: 17933 - RNA, 18 nt, artificial
  Chemically synthesized
acauguggcucccaaaag

SEQ ID NO: 17934 - RNA, 18 nt, artificial
  Chemically synthesized
guaggacaaguagcucug

SEQ ID NO: 17935 - RNA, 18 nt, artificial
  Chemically synthesized
uccaguucugaccacccu

SEQ ID NO: 17936 - RNA, 18 nt, artificial
  Chemically synthesized
gaagaucugggaguguuc

SEQ ID NO: 17937 - RNA, 18 nt, artificial
  Chemically synthesized
acaggugggugcagccuc

SEQ ID NO: 17938 - RNA, 18 nt, artificial
  Chemically synthesized
aggugguaucuucuacag

SEQ ID NO: 17939 - RNA, 18 nt, artificial
  Chemically synthesized
agggcugccaguggaucg

SEQ ID NO: 17940 - RNA, 18 nt, artificial
  Chemically synthesized
agcccaggaggugggcug

SEQ ID NO: 17941 - RNA, 18 nt, artificial
  Chemically synthesized
acccucucugguuccaca

SEQ ID NO: 17942 - RNA, 18 nt, artificial
  Chemically synthesized
ugcggugcaggcugagga

SEQ ID NO: 17943 - RNA, 18 nt, artificial
  Chemically synthesized
uggcugauuuccaaguug

SEQ ID NO: 17944 - RNA, 18 nt, artificial
  Chemically synthesized
uggcgaagaucugggagu

SEQ ID NO: 17945 - RNA, 18 nt, artificial
  Chemically synthesized
ugggacccucucugguuc

SEQ ID NO: 17946 - RNA, 18 nt, artificial
  Chemically synthesized
uacagaaaguuggagugg

SEQ ID NO: 17947 - RNA, 18 nt, artificial
  Chemically synthesized
gaaaguuggaguggcguc

SEQ ID NO: 17948 - RNA, 18 nt, artificial
  Chemically synthesized
aaagccgaggaugguggg

SEQ ID NO: 17949 - RNA, 18 nt, artificial
  Chemically synthesized
gcaccuggaaauccucgc

SEQ ID NO: 17950 - RNA, 18 nt, artificial
  Chemically synthesized
gagcugcuccaucugugc

SEQ ID NO: 17951 - RNA, 18 nt, artificial
  Chemically synthesized
ggcugcgccacugggucc

SEQ ID NO: 17952 - RNA, 18 nt, artificial
  Chemically synthesized
ggcuugguauuuggagag

SEQ ID NO: 17953 - RNA, 18 nt, artificial
  Chemically synthesized
ugcugcaccuagaauguc

SEQ ID NO: 17954 - RNA, 18 nt, artificial
  Chemically synthesized
caagugggaaaggguggc

SEQ ID NO: 17955 - RNA, 18 nt, artificial
  Chemically synthesized
ccagcaggugguacaagc

SEQ ID NO: 17956 - RNA, 18 nt, artificial
  Chemically synthesized
accggcuccagaauaggc

SEQ ID NO: 17957 - RNA, 18 nt, artificial
  Chemically synthesized
guuggaguggcgucuggu

SEQ ID NO: 17958 - RNA, 18 nt, artificial
  Chemically synthesized
uggcguggaggaucacaa

SEQ ID NO: 17959 - RNA, 18 nt, artificial
  Chemically synthesized
uacaagcgggccacagcc

SEQ ID NO: 17960 - RNA, 18 nt, artificial
  Chemically synthesized
aagguguuggccaccuuc

SEQ ID NO: 17961 - RNA, 18 nt, artificial
  Chemically synthesized
cacuggguaguuggugcu

SEQ ID NO: 17962 - RNA, 18 nt, artificial
  Chemically synthesized
aggaagggaacagggagg

SEQ ID NO: 17963 - RNA, 18 nt, artificial
  Chemically synthesized
agggugcggacggcuucc

SEQ ID NO: 17964 - RNA, 18 nt, artificial
  Chemically synthesized
ccugguaggacaaguagc

SEQ ID NO: 17965 - RNA, 18 nt, artificial
  Chemically synthesized
cagcaaugucccacccac

SEQ ID NO: 17966 - RNA, 18 nt, artificial
  Chemically synthesized
cgcugagggcgcuggcuc

SEQ ID NO: 17967 - RNA, 18 nt, artificial
  Chemically synthesized
ugaaggcauguuccacac

SEQ ID NO: 17968 - RNA, 18 nt, artificial
  Chemically synthesized
ggcauguuccacacugcc

SEQ ID NO: 17969 - RNA, 18 nt, artificial
  Chemically synthesized
ggaagggcagugacugug

SEQ ID NO: 17970 - RNA, 18 nt, artificial
  Chemically synthesized
ggcuucugcggaguugcc

SEQ ID NO: 17971 - RNA, 18 nt, artificial
  Chemically synthesized
ccuucugcacgcccagug

SEQ ID NO: 17972 - RNA, 18 nt, artificial
  Chemically synthesized
ccuagaaugucgaaggcg

SEQ ID NO: 17973 - RNA, 18 nt, artificial
  Chemically synthesized
ggugcaggcugaggaagg

SEQ ID NO: 17974 - RNA, 18 nt, artificial
  Chemically synthesized
ugguaggacaaguagcuc

SEQ ID NO: 17975 - RNA, 18 nt, artificial
  Chemically synthesized
ugucggagcugagcuggg

SEQ ID NO: 17976 - RNA, 18 nt, artificial
  Chemically synthesized
guggugggaguagguggg

SEQ ID NO: 17977 - RNA, 18 nt, artificial
  Chemically synthesized
accuggagcugcuccauc

SEQ ID NO: 17978 - RNA, 18 nt, artificial
  Chemically synthesized
guaggcugcguucagugc

SEQ ID NO: 17979 - RNA, 18 nt, artificial
  Chemically synthesized
cucucugguuccacaugu

SEQ ID NO: 17980 - RNA, 18 nt, artificial
  Chemically synthesized
cguggaggaucacaaagu

SEQ ID NO: 17981 - RNA, 18 nt, artificial
  Chemically synthesized
uccucagccagcaggugg

SEQ ID NO: 17982 - RNA, 18 nt, artificial
  Chemically synthesized
agggccuccagcuucucc

SEQ ID NO: 17983 - RNA, 18 nt, artificial
  Chemically synthesized
auguccugaaaguggcag

SEQ ID NO: 17984 - RNA, 18 nt, artificial
  Chemically synthesized
ugggaggcuccugguccc

SEQ ID NO: 17985 - RNA, 18 nt, artificial
  Chemically synthesized
aaggacacgcggucauuc

SEQ ID NO: 17986 - RNA, 18 nt, artificial
  Chemically synthesized
ucccagagggcaaagccg

SEQ ID NO: 17987 - RNA, 18 nt, artificial
  Chemically synthesized
uccggcagcagaagcugg

SEQ ID NO: 17988 - RNA, 18 nt, artificial
  Chemically synthesized
agccugccaugcgugcag

SEQ ID NO: 17989 - RNA, 18 nt, artificial
  Chemically synthesized
uccucuggguccucggug

SEQ ID NO: 17990 - RNA, 18 nt, artificial
  Chemically synthesized
ugguuccacaugugguug

SEQ ID NO: 17991 - RNA, 18 nt, artificial
  Chemically synthesized
cacuccacuggguaguug

SEQ ID NO: 17992 - RNA, 18 nt, artificial
  Chemically synthesized
uuuuugaccggcuccaga

SEQ ID NO: 17993 - RNA, 18 nt, artificial
  Chemically synthesized
gaauuucuguuccgauga

SEQ ID NO: 17994 - RNA, 18 nt, artificial
  Chemically synthesized
ugccugguaggacaagua

SEQ ID NO: 17995 - RNA, 18 nt, artificial
  Chemically synthesized
ucuucaguuugugcuuca

SEQ ID NO: 17996 - RNA, 18 nt, artificial
  Chemically synthesized
uccaucugugccugguag

SEQ ID NO: 17997 - RNA, 18 nt, artificial
  Chemically synthesized
agggaacagggaggaggg

SEQ ID NO: 17998 - RNA, 18 nt, artificial
  Chemically synthesized
caggugggugcagccucc

SEQ ID NO: 17999 - RNA, 18 nt, artificial
  Chemically synthesized
gucuggucuuugacagag

SEQ ID NO: 18000 - RNA, 18 nt, artificial
  Chemically synthesized
cuccugcgucuuguccuc

SEQ ID NO: 18001 - RNA, 18 nt, artificial
  Chemically synthesized
agaugaccucaucuucca

SEQ ID NO: 18002 - RNA, 18 nt, artificial
  Chemically synthesized
ccggcugcgccacugggu

SEQ ID NO: 18003 - RNA, 18 nt, artificial
  Chemically synthesized
agguucugcaggagcugc

SEQ ID NO: 18004 - RNA, 18 nt, artificial
  Chemically synthesized
auuccagggaggaaggga

SEQ ID NO: 18005 - RNA, 18 nt, artificial
  Chemically synthesized
ucugcccuggcguggagg

SEQ ID NO: 18006 - RNA, 18 nt, artificial
  Chemically synthesized
ggacaaguagcucuggag

SEQ ID NO: 18007 - RNA, 18 nt, artificial
  Chemically synthesized
guaggcugaguaggcugc

SEQ ID NO: 18008 - RNA, 18 nt, artificial
  Chemically synthesized
gucuauggcguccugcag

SEQ ID NO: 18009 - RNA, 18 nt, artificial
  Chemically synthesized
ccgccugcauccgcucac

SEQ ID NO: 18010 - RNA, 18 nt, artificial
  Chemically synthesized
ugaugaaagcugaguggu

SEQ ID NO: 18011 - RNA, 18 nt, artificial
  Chemically synthesized
cuggugcaggcucaggcg

SEQ ID NO: 18012 - RNA, 18 nt, artificial
  Chemically synthesized
ggcuugaagguguuggcc

SEQ ID NO: 18013 - RNA, 18 nt, artificial
  Chemically synthesized
aggcucaggcgacagucg

SEQ ID NO: 18014 - RNA, 18 nt, artificial
  Chemically synthesized
agggcaucaucgcgcccg

SEQ ID NO: 18015 - RNA, 18 nt, artificial
  Chemically synthesized
acccuucacccagaaaua

SEQ ID NO: 18016 - RNA, 18 nt, artificial
  Chemically synthesized
cuugguucaccuggugca

SEQ ID NO: 18017 - RNA, 18 nt, artificial
  Chemically synthesized
gugucggagcugagcugg

SEQ ID NO: 18018 - RNA, 18 nt, artificial
  Chemically synthesized
gcagaucagggauccggg

SEQ ID NO: 18019 - RNA, 18 nt, artificial
  Chemically synthesized
cuugguauuuggagaggu

SEQ ID NO: 18020 - RNA, 18 nt, artificial
  Chemically synthesized
ugguuucuggagcugcgg

SEQ ID NO: 18021 - RNA, 18 nt, artificial
  Chemically synthesized
gacaauguccugaaagug

SEQ ID NO: 18022 - RNA, 18 nt, artificial
  Chemically synthesized
cgccugcauccgcucacc

SEQ ID NO: 18023 - RNA, 18 nt, artificial
  Chemically synthesized
aucggccuucaaugccuc

SEQ ID NO: 18024 - RNA, 18 nt, artificial
  Chemically synthesized
uccuguuccuuccuccac

SEQ ID NO: 18025 - RNA, 18 nt, artificial
  Chemically synthesized
acagcuucuccucagcca

SEQ ID NO: 18026 - RNA, 18 nt, artificial
  Chemically synthesized
gcugagggcgcuggcucc

SEQ ID NO: 18027 - RNA, 18 nt, artificial
  Chemically synthesized
uuuccaaguugcuggcca

SEQ ID NO: 18028 - RNA, 18 nt, artificial
  Chemically synthesized
accuggaaauccucgcag

SEQ ID NO: 18029 - RNA, 18 nt, artificial
  Chemically synthesized
gugccagccugccaugcg

SEQ ID NO: 18030 - RNA, 18 nt, artificial
  Chemically synthesized
ggcgcuaggaagugaugg

SEQ ID NO: 18031 - RNA, 18 nt, artificial
  Chemically synthesized
cuggguaguuggugcugg

SEQ ID NO: 18032 - RNA, 18 nt, artificial
  Chemically synthesized
uggccgaugccugggucc

SEQ ID NO: 18033 - RNA, 18 nt, artificial
  Chemically synthesized
gggaggaagggaacaggg

SEQ ID NO: 18034 - RNA, 18 nt, artificial
  Chemically synthesized
uggcguccugcaggcagc

SEQ ID NO: 18035 - RNA, 18 nt, artificial
  Chemically synthesized
uuggugcugguuucugga

SEQ ID NO: 18036 - RNA, 18 nt, artificial
  Chemically synthesized
aaguagcucuggagguag

SEQ ID NO: 18037 - RNA, 18 nt, artificial
  Chemically synthesized
gugaaggcauguuccaca

SEQ ID NO: 18038 - RNA, 18 nt, artificial
  Chemically synthesized
aagcccaggaggugggcu

SEQ ID NO: 18039 - RNA, 18 nt, artificial
  Chemically synthesized
ugagggcgcuggcuccac

SEQ ID NO: 18040 - RNA, 18 nt, artificial
  Chemically synthesized
ugugcgugguggauaaug

SEQ ID NO: 18041 - RNA, 18 nt, artificial
  Chemically synthesized
ccgugucggagcugagcu

SEQ ID NO: 18042 - RNA, 18 nt, artificial
  Chemically synthesized
cuucucccgaacccgcag

SEQ ID NO: 18043 - RNA, 18 nt, artificial
  Chemically synthesized
ugagcugaacaaggagua

SEQ ID NO: 18044 - RNA, 18 nt, artificial
  Chemically synthesized
ccgaugccuggguccagg

SEQ ID NO: 18045 - RNA, 18 nt, artificial
  Chemically synthesized
cggagagcaggcuggccg

SEQ ID NO: 18046 - RNA, 18 nt, artificial
  Chemically synthesized
cugccggcugcgccacug

SEQ ID NO: 18047 - RNA, 18 nt, artificial
  Chemically synthesized
aagcagaucagggauccg

SEQ ID NO: 18048 - RNA, 18 nt, artificial
  Chemically synthesized
uugcagcccugggcucug

SEQ ID NO: 18049 - RNA, 18 nt, artificial
  Chemically synthesized
ccgccuucugcacgccca

SEQ ID NO: 18050 - RNA, 18 nt, artificial
  Chemically synthesized
gugagcugaacaaggagu

SEQ ID NO: 18051 - RNA, 18 nt, artificial
  Chemically synthesized
aaguugcuggccagggag

SEQ ID NO: 18052 - RNA, 18 nt, artificial
  Chemically synthesized
ccucauccugaaguuccc

SEQ ID NO: 18053 - RNA, 18 nt, artificial
  Chemically synthesized
guaucuucuacagaaagu

SEQ ID NO: 18054 - RNA, 18 nt, artificial
  Chemically synthesized
guaguuggugcugguuuc

SEQ ID NO: 18055 - RNA, 18 nt, artificial
  Chemically synthesized
gcuucucccgaacccgca

SEQ ID NO: 18056 - RNA, 18 nt, artificial
  Chemically synthesized
ucuggugggcuggcaauc

SEQ ID NO: 18057 - RNA, 18 nt, artificial
  Chemically synthesized
aguguucguccagccgca

SEQ ID NO: 18058 - RNA, 18 nt, artificial
  Chemically synthesized
guuuuugaccggcuccag

SEQ ID NO: 18059 - RNA, 18 nt, artificial
  Chemically synthesized
cggcuugguauuuggaga

SEQ ID NO: 18060 - RNA, 18 nt, artificial
  Chemically synthesized
cccgccuucugcacgccc

SEQ ID NO: 18061 - RNA, 18 nt, artificial
  Chemically synthesized
uggcaugcaggagguccu

SEQ ID NO: 18062 - RNA, 18 nt, artificial
  Chemically synthesized
ggguuuuugaccggcucc

SEQ ID NO: 18063 - RNA, 18 nt, artificial
  Chemically synthesized
cagguguuggcucuguuc

SEQ ID NO: 18064 - RNA, 18 nt, artificial
  Chemically synthesized
agguaggcugaguaggcu

SEQ ID NO: 18065 - RNA, 18 nt, artificial
  Chemically synthesized
cucaggcuccuggcagcc

SEQ ID NO: 18066 - RNA, 18 nt, artificial
  Chemically synthesized
agggcucccggacaaugu

SEQ ID NO: 18067 - RNA, 18 nt, artificial
  Chemically synthesized
accaagacccuucaccca

SEQ ID NO: 18068 - RNA, 18 nt, artificial
  Chemically synthesized
uucaggagaaccauggca

SEQ ID NO: 18069 - RNA, 18 nt, artificial
  Chemically synthesized
accuagaaugucgaaggc

SEQ ID NO: 18070 - RNA, 18 nt, artificial
  Chemically synthesized
cccuucacccagaaauag

SEQ ID NO: 18071 - RNA, 18 nt, artificial
  Chemically synthesized
cuugcugggcccaugugg

SEQ ID NO: 18072 - RNA, 18 nt, artificial
  Chemically synthesized
accguagcgcgcugaggg

SEQ ID NO: 18073 - RNA, 18 nt, artificial
  Chemically synthesized
aggugggcugcuuggcag

SEQ ID NO: 18074 - RNA, 18 nt, artificial
  Chemically synthesized
aagcuggagguggugaag

SEQ ID NO: 18075 - RNA, 18 nt, artificial
  Chemically synthesized
augacauguggcucccaa

SEQ ID NO: 18076 - RNA, 18 nt, artificial
  Chemically synthesized
ugggcugcggugcaggcu

SEQ ID NO: 18077 - RNA, 18 nt, artificial
  Chemically synthesized
gcgccugggacccucucu

SEQ ID NO: 18078 - RNA, 18 nt, artificial
  Chemically synthesized
aagugaugggccugugca

SEQ ID NO: 18079 - RNA, 18 nt, artificial
  Chemically synthesized
gggcgauguguucgucug

SEQ ID NO: 18080 - RNA, 18 nt, artificial
  Chemically synthesized
accuggugcaggcucagg

SEQ ID NO: 18081 - RNA, 18 nt, artificial
  Chemically synthesized
uuccagguucugcaggag

SEQ ID NO: 18082 - RNA, 18 nt, artificial
  Chemically synthesized
uuucgggccugaagccug

SEQ ID NO: 18083 - RNA, 18 nt, artificial
  Chemically synthesized
ugcgugguggauaaugag

SEQ ID NO: 18084 - RNA, 18 nt, artificial
  Chemically synthesized
aggugagaaguaggauga

SEQ ID NO: 18085 - RNA, 18 nt, artificial
  Chemically synthesized
uugaagguguuggccacc

SEQ ID NO: 18086 - RNA, 18 nt, artificial
  Chemically synthesized
gcuccuggucccagaggg

SEQ ID NO: 18087 - RNA, 18 nt, artificial
  Chemically synthesized
auuuccaaguugcuggcc

SEQ ID NO: 18088 - RNA, 18 nt, artificial
  Chemically synthesized
gguaggcugaguaggcug

SEQ ID NO: 18089 - RNA, 18 nt, artificial
  Chemically synthesized
aggcagcccagauuggac

SEQ ID NO: 18090 - RNA, 18 nt, artificial
  Chemically synthesized
gggacuggcugauuucca

SEQ ID NO: 18091 - RNA, 18 nt, artificial
  Chemically synthesized
cgguuucgggccucaucc

SEQ ID NO: 18092 - RNA, 18 nt, artificial
  Chemically synthesized
ucuggagguaggcugagu

SEQ ID NO: 18093 - RNA, 18 nt, artificial
  Chemically synthesized
gcugcuccaucugugccu

SEQ ID NO: 18094 - RNA, 18 nt, artificial
  Chemically synthesized
gaggaagggaacagggag

SEQ ID NO: 18095 - RNA, 18 nt, artificial
  Chemically synthesized
ugcuuggcagcucuggug

SEQ ID NO: 18096 - RNA, 18 nt, artificial
  Chemically synthesized
agguggucaggcaaggac

SEQ ID NO: 18097 - RNA, 18 nt, artificial
  Chemically synthesized
uaggugggcacggcuugg

SEQ ID NO: 18098 - RNA, 18 nt, artificial
  Chemically synthesized
acagucgaaguuggaggu

SEQ ID NO: 18099 - RNA, 18 nt, artificial
  Chemically synthesized
agaaaguuggaguggcgu

SEQ ID NO: 18100 - RNA, 18 nt, artificial
  Chemically synthesized
ugucgcgugagguugcuc

SEQ ID NO: 18101 - RNA, 18 nt, artificial
  Chemically synthesized
ugcaggcucaggcgacag

SEQ ID NO: 18102 - RNA, 18 nt, artificial
  Chemically synthesized
uccugcgucuuguccucg

SEQ ID NO: 18103 - RNA, 18 nt, artificial
  Chemically synthesized
agcugagggugcggacgg

SEQ ID NO: 18104 - RNA, 18 nt, artificial
  Chemically synthesized
uaguuggugcugguuucu

SEQ ID NO: 18105 - RNA, 18 nt, artificial
  Chemically synthesized
augggcacaggugggugc

SEQ ID NO: 18106 - RNA, 18 nt, artificial
  Chemically synthesized
cugcaccuagaaugucga

SEQ ID NO: 18107 - RNA, 18 nt, artificial
  Chemically synthesized
ggcgugggaggcuccugg

SEQ ID NO: 18108 - RNA, 18 nt, artificial
  Chemically synthesized
ugcgccacuggguccugg

SEQ ID NO: 18109 - RNA, 18 nt, artificial
  Chemically synthesized
ccgccgccugcauccgcu

SEQ ID NO: 18110 - RNA, 18 nt, artificial
  Chemically synthesized
cccagauuggacuggagc

SEQ ID NO: 18111 - RNA, 18 nt, artificial
  Chemically synthesized
agaaguaggaugaugaaa

SEQ ID NO: 18112 - RNA, 18 nt, artificial
  Chemically synthesized
gcugaacaaggaguagau

SEQ ID NO: 18113 - RNA, 18 nt, artificial
  Chemically synthesized
cuccuggucccagagggc

SEQ ID NO: 18114 - RNA, 18 nt, artificial
  Chemically synthesized
gucgaaguuggaggugag

SEQ ID NO: 18115 - RNA, 18 nt, artificial
  Chemically synthesized
ucacagagcuugcugggc

SEQ ID NO: 18116 - RNA, 18 nt, artificial
  Chemically synthesized
acgccaagggccuccagc

SEQ ID NO: 18117 - RNA, 18 nt, artificial
  Chemically synthesized
gccugggacccucucugg

SEQ ID NO: 18118 - RNA, 18 nt, artificial
  Chemically synthesized
gccaccuggagcugcucc

SEQ ID NO: 18119 - RNA, 18 nt, artificial
  Chemically synthesized
caucggccuucaaugccu

SEQ ID NO: 18120 - RNA, 18 nt, artificial
  Chemically synthesized
gcaggugguacaagcggg

SEQ ID NO: 18121 - RNA, 18 nt, artificial
  Chemically synthesized
caaaagccaccuggagcu

SEQ ID NO: 18122 - RNA, 18 nt, artificial
  Chemically synthesized
ucccuggagcugagggug

SEQ ID NO: 18123 - RNA, 18 nt, artificial
  Chemically synthesized
auccucgcagaagguggc

SEQ ID NO: 18124 - RNA, 18 nt, artificial
  Chemically synthesized
aggccguagggaaggcug

SEQ ID NO: 18125 - RNA, 18 nt, artificial
  Chemically synthesized
ugcaggagcugcccaagc

SEQ ID NO: 18126 - RNA, 18 nt, artificial
  Chemically synthesized
cugaacaaggaguagaug

SEQ ID NO: 18127 - RNA, 18 nt, artificial
  Chemically synthesized
aggcuccuggcagccacc

SEQ ID NO: 18128 - RNA, 18 nt, artificial
  Chemically synthesized
agucgaaguuggagguga

SEQ ID NO: 18129 - RNA, 18 nt, artificial
  Chemically synthesized
ggucgucacagagcuugc

SEQ ID NO: 18130 - RNA, 18 nt, artificial
  Chemically synthesized
cuucaggagaaccauggc

SEQ ID NO: 18131 - RNA, 18 nt, artificial
  Chemically synthesized
gcaucggccuucaaugcc

SEQ ID NO: 18132 - RNA, 18 nt, artificial
  Chemically synthesized
agcuucuccucagccagc

SEQ ID NO: 18133 - RNA, 18 nt, artificial
  Chemically synthesized
aggaggugggcugcuugg

SEQ ID NO: 18134 - RNA, 18 nt, artificial
  Chemically synthesized
gugguaucuucuacagaa

SEQ ID NO: 18135 - RNA, 18 nt, artificial
  Chemically synthesized
gugagguugcucaucaug

SEQ ID NO: 18136 - RNA, 18 nt, artificial
  Chemically synthesized
cgucuuguccucgggcgc

SEQ ID NO: 18137 - RNA, 18 nt, artificial
  Chemically synthesized
gcacaggugggugcagcc

SEQ ID NO: 18138 - RNA, 18 nt, artificial
  Chemically synthesized
acccugaaagccagggca

SEQ ID NO: 18139 - RNA, 18 nt, artificial
  Chemically synthesized
aauuucuguuccgaugau

SEQ ID NO: 18140 - RNA, 18 nt, artificial
  Chemically synthesized
cagaaaguuggaguggcg

SEQ ID NO: 18141 - RNA, 18 nt, artificial
  Chemically synthesized
aggcaaggacacgcgguc

SEQ ID NO: 18142 - RNA, 18 nt, artificial
  Chemically synthesized
augucccacccacaccgg

SEQ ID NO: 18143 - RNA, 18 nt, artificial
  Chemically synthesized
augaagggcucccggaca

SEQ ID NO: 18144 - RNA, 18 nt, artificial
  Chemically synthesized
aggugggugcagccuccg

SEQ ID NO: 18145 - RNA, 18 nt, artificial
  Chemically synthesized
gcuugguucaccuggugc

SEQ ID NO: 18146 - RNA, 18 nt, artificial
  Chemically synthesized
uguucccgcagggcucgg

SEQ ID NO: 18147 - RNA, 18 nt, artificial
  Chemically synthesized
gugcacuccacuggguag

SEQ ID NO: 18148 - RNA, 18 nt, artificial
  Chemically synthesized
cacauggccuuucgggcc

SEQ ID NO: 18149 - RNA, 18 nt, artificial
  Chemically synthesized
gcuggagguggugaaggc

SEQ ID NO: 18150 - RNA, 18 nt, artificial
  Chemically synthesized
cagcuguaccaucugugc

SEQ ID NO: 18151 - RNA, 18 nt, artificial
  Chemically synthesized
aggagaaccauggcaugc

SEQ ID NO: 18152 - RNA, 18 nt, artificial
  Chemically synthesized
uuccagggaggaagggaa

SEQ ID NO: 18153 - RNA, 18 nt, artificial
  Chemically synthesized
cccagcuucaggagaacc

SEQ ID NO: 18154 - RNA, 18 nt, artificial
  Chemically synthesized
ccguccagguguuggcuc

SEQ ID NO: 18155 - RNA, 18 nt, artificial
  Chemically synthesized
aggauggugggaggcagc

SEQ ID NO: 18156 - RNA, 18 nt, artificial
  Chemically synthesized
cugcaggcagcucagcuc

SEQ ID NO: 18157 - RNA, 18 nt, artificial
  Chemically synthesized
cacgcggucauucugccu

SEQ ID NO: 18158 - RNA, 18 nt, artificial
  Chemically synthesized
uucgucugcccuggcgug

SEQ ID NO: 18159 - RNA, 18 nt, artificial
  Chemically synthesized
agugccgccgccugcauc

SEQ ID NO: 18160 - RNA, 18 nt, artificial
  Chemically synthesized
aaauccucgcagaaggug

SEQ ID NO: 18161 - RNA, 18 nt, artificial
  Chemically synthesized
uaaacaccguauccaguu

SEQ ID NO: 18162 - RNA, 18 nt, artificial
  Chemically synthesized
cgccuucugcacgcccag

SEQ ID NO: 18163 - RNA, 18 nt, artificial
  Chemically synthesized
agcaggugguacaagcgg

SEQ ID NO: 18164 - RNA, 18 nt, artificial
  Chemically synthesized
gucacagagcuugcuggg

SEQ ID NO: 18165 - RNA, 18 nt, artificial
  Chemically synthesized
aaugacauguggcuccca

SEQ ID NO: 18166 - RNA, 18 nt, artificial
  Chemically synthesized
cagggaggcagggcugcc

SEQ ID NO: 18167 - RNA, 18 nt, artificial
  Chemically synthesized
cggaguugcccgcggacc

SEQ ID NO: 18168 - RNA, 18 nt, artificial
  Chemically synthesized
cuucaaugccucuagaga

SEQ ID NO: 18169 - RNA, 18 nt, artificial
  Chemically synthesized
agcugcccaagcagauca

SEQ ID NO: 18170 - RNA, 18 nt, artificial
  Chemically synthesized
gcacccuuggcuccaguc

SEQ ID NO: 18171 - RNA, 18 nt, artificial
  Chemically synthesized
cucaucuuccacugucca

SEQ ID NO: 18172 - RNA, 18 nt, artificial
  Chemically synthesized
ggcugaggaagggcaugg

SEQ ID NO: 18173 - RNA, 18 nt, artificial
  Chemically synthesized
guccagccgcaccagccc

SEQ ID NO: 18174 - RNA, 18 nt, artificial
  Chemically synthesized
gaaaggcugcuggcugug

SEQ ID NO: 18175 - RNA, 18 nt, artificial
  Chemically synthesized
ugcgucuuguccucgggc

SEQ ID NO: 18176 - RNA, 18 nt, artificial
  Chemically synthesized
gaugacacagucuggcga

SEQ ID NO: 18177 - RNA, 18 nt, artificial
  Chemically synthesized
ucgcgcccguuuuguccu

SEQ ID NO: 18178 - RNA, 18 nt, artificial
  Chemically synthesized
gggucgucacagagcuug

SEQ ID NO: 18179 - RNA, 18 nt, artificial
  Chemically synthesized
cagggcacagggcagacc

SEQ ID NO: 18180 - RNA, 18 nt, artificial
  Chemically synthesized
aucgcagggagcacccuu

SEQ ID NO: 18181 - RNA, 18 nt, artificial
  Chemically synthesized
gacuggagcguccggaug

SEQ ID NO: 18182 - RNA, 18 nt, artificial
  Chemically synthesized
ccaugugggcugcggugc

SEQ ID NO: 18183 - RNA, 18 nt, artificial
  Chemically synthesized
ugcggacggcuuccuggu

SEQ ID NO: 18184 - RNA, 18 nt, artificial
  Chemically synthesized
caggcucgggcaccaagc

SEQ ID NO: 18185 - RNA, 18 nt, artificial
  Chemically synthesized
cugccaguggaucgcagg

SEQ ID NO: 18186 - RNA, 18 nt, artificial
  Chemically synthesized
cguccagguguuggcucu

SEQ ID NO: 18187 - RNA, 18 nt, artificial
  Chemically synthesized
ucgggcacgccaagggcc

SEQ ID NO: 18188 - RNA, 18 nt, artificial
  Chemically synthesized
guucaccuggugcaggcu

SEQ ID NO: 18189 - RNA, 18 nt, artificial
  Chemically synthesized
uucccgcagggcucgggu

SEQ ID NO: 18190 - RNA, 18 nt, artificial
  Chemically synthesized
gcagugacuguggaaagg

SEQ ID NO: 18191 - RNA, 18 nt, artificial
  Chemically synthesized
ccucggugcacuccacug

SEQ ID NO: 18192 - RNA, 18 nt, artificial
  Chemically synthesized
uguggcucccaaaagcca

SEQ ID NO: 18193 - RNA, 18 nt, artificial
  Chemically synthesized
cuccggcagcagaagcug

SEQ ID NO: 18194 - RNA, 18 nt, artificial
  Chemically synthesized
ugccgccgccugcauccg

SEQ ID NO: 18195 - RNA, 18 nt, artificial
  Chemically synthesized
uccucggugcuguccacg

SEQ ID NO: 18196 - RNA, 18 nt, artificial
  Chemically synthesized
uucaguuugugcuucaga

SEQ ID NO: 18197 - RNA, 18 nt, artificial
  Chemically synthesized
ugccucuagagagauccu

SEQ ID NO: 18198 - RNA, 18 nt, artificial
  Chemically synthesized
cugauuuccaaguugcug

SEQ ID NO: 18199 - RNA, 18 nt, artificial
  Chemically synthesized
augugggcugcggugcag

SEQ ID NO: 18200 - RNA, 18 nt, artificial
  Chemically synthesized
ccagcuucaggagaacca

SEQ ID NO: 18201 - RNA, 18 nt, artificial
  Chemically synthesized
ccaaagggcauucgagcc

SEQ ID NO: 18202 - RNA, 18 nt, artificial
  Chemically synthesized
gggccugaagccuguggg

SEQ ID NO: 18203 - RNA, 18 nt, artificial
  Chemically synthesized
cagggaggaagggaacag

SEQ ID NO: 18204 - RNA, 18 nt, artificial
  Chemically synthesized
gccaagugggaaagggug

SEQ ID NO: 18205 - RNA, 18 nt, artificial
  Chemically synthesized
gcuccucuggguccucgg

SEQ ID NO: 18206 - RNA, 18 nt, artificial
  Chemically synthesized
gguugcucaucauggcuu

SEQ ID NO: 18207 - RNA, 18 nt, artificial
  Chemically synthesized
cugagggugcggacggcu

SEQ ID NO: 18208 - RNA, 18 nt, artificial
  Chemically synthesized
cugcauccgcucaccguc

SEQ ID NO: 18209 - RNA, 18 nt, artificial
  Chemically synthesized
ugcuccaucugugccugg

SEQ ID NO: 18210 - RNA, 18 nt, artificial
  Chemically synthesized
caggugguacaagcgggc

SEQ ID NO: 18211 - RNA, 18 nt, artificial
  Chemically synthesized
ugacauguggcucccaaa

SEQ ID NO: 18212 - RNA, 18 nt, artificial
  Chemically synthesized
gugcaggcugaggaaggg

SEQ ID NO: 18213 - RNA, 18 nt, artificial
  Chemically synthesized
gugggaguaggugggcac

SEQ ID NO: 18214 - RNA, 18 nt, artificial
  Chemically synthesized
guagcucuggagguaggc

SEQ ID NO: 18215 - RNA, 18 nt, artificial
  Chemically synthesized
auggcggccagcucaucu

SEQ ID NO: 18216 - RNA, 18 nt, artificial
  Chemically synthesized
uucugcaggagcugccca

SEQ ID NO: 18217 - RNA, 18 nt, artificial
  Chemically synthesized
ccuuccuggcgaagaucu

SEQ ID NO: 18218 - RNA, 18 nt, artificial
  Chemically synthesized
guugcagcccugggcucu

SEQ ID NO: 18219 - RNA, 18 nt, artificial
  Chemically synthesized
cugcuccaucugugccug

SEQ ID NO: 18220 - RNA, 18 nt, artificial
  Chemically synthesized
agccgguggucgucccug

SEQ ID NO: 18221 - RNA, 18 nt, artificial
  Chemically synthesized
cagauuggacuggagcgu

SEQ ID NO: 18222 - RNA, 18 nt, artificial
  Chemically synthesized
ccagauuggacuggagcg

SEQ ID NO: 18223 - RNA, 18 nt, artificial
  Chemically synthesized
ccagcucaucuccucagg

SEQ ID NO: 18224 - RNA, 18 nt, artificial
  Chemically synthesized
uuugugcuucagauacaa

SEQ ID NO: 18225 - RNA, 18 nt, artificial
  Chemically synthesized
guauuuggagagguggua

SEQ ID NO: 18226 - RNA, 18 nt, artificial
  Chemically synthesized
aucaucgcgcccguuuug

SEQ ID NO: 18227 - RNA, 18 nt, artificial
  Chemically synthesized
cagcaggugguacaagcg

SEQ ID NO: 18228 - RNA, 18 nt, artificial
  Chemically synthesized
ggaggugggcugcuuggc

SEQ ID NO: 18229 - RNA, 18 nt, artificial
  Chemically synthesized
aacaccguauccaguucu

SEQ ID NO: 18230 - RNA, 18 nt, artificial
  Chemically synthesized
ugguaggccacgucccgc

SEQ ID NO: 18231 - RNA, 18 nt, artificial
  Chemically synthesized
cagcccugggcucugagg

SEQ ID NO: 18232 - RNA, 18 nt, artificial
  Chemically synthesized
cuguuccagguucugcag

SEQ ID NO: 18233 - RNA, 18 nt, artificial
  Chemically synthesized
guaucagggaggccagug

SEQ ID NO: 18234 - RNA, 18 nt, artificial
  Chemically synthesized
ccuggagcugcuccaucu

SEQ ID NO: 18235 - RNA, 18 nt, artificial
  Chemically synthesized
gcgugagguugcucauca

SEQ ID NO: 18236 - RNA, 18 nt, Artificial Sequence
  Chemically synthesized
cuccacauggccuuucgg

SEQ ID NO: 18237 - RNA, 18 nt, artificial
  Chemically synthesized
guaccaccugcuggcuga

SEQ ID NO: 18238 - RNA, 18 nt, artificial
  Chemically synthesized
uuguaccaccugcuggcu

SEQ ID NO: 18239 - RNA, 18 nt, artificial
  Chemically synthesized
uaccaccugcuggcugag

SEQ ID NO: 18240 - RNA, 18 nt, artificial
  Chemically synthesized
ucagccagcaggugguac

SEQ ID NO: 18241 - RNA, 18 nt, artificial
  Chemically synthesized
agccagcaggugguacaa

SEQ ID NO: 18242 - RNA, 18 nt, Artificial Sequence
  Chemically synthesized
cucagccagcagguggua

SEQ ID NO: 18243 - RNA, 19 nt, artificial
  Chemically synthesized
ggcagacccugcugaagaa

SEQ ID NO: 18244 - RNA, 19 nt, artificial
  Chemically synthesized
gagaagugucacuagaaua

SEQ ID NO: 18245 - RNA, 19 nt, artificial
  Chemically synthesized
ggagaagugucacuagaau

SEQ ID NO: 18246 - RNA, 19 nt, artificial
  Chemically synthesized
cuaagaagccucuaggcaa

SEQ ID NO: 18247 - RNA, 19 nt, artificial
  Chemically synthesized
caguaaguuuguuguugaa

SEQ ID NO: 18248 - RNA, 19 nt, artificial
  Chemically synthesized
gguggagcagagaacaguu

SEQ ID NO: 18249 - RNA, 19 nt, artificial
  Chemically synthesized
guuuguuguugaacugaaa

SEQ ID NO: 18250 - RNA, 19 nt, artificial
  Chemically synthesized
agacaucgauucacuucaa

SEQ ID NO: 18251 - RNA, 19 nt, artificial
  Chemically synthesized
cucuaguucuagaaagaga

SEQ ID NO: 18252 - RNA, 19 nt, artificial
  Chemically synthesized
agaagaccauggagagcuu

SEQ ID NO: 18253 - RNA, 19 nt, artificial
  Chemically synthesized
gcugauacuuucacaguca

SEQ ID NO: 18254 - RNA, 19 nt, artificial
  Chemically synthesized
acacaaaccuagaagccua

SEQ ID NO: 18255 - RNA, 19 nt, artificial
  Chemically synthesized
aggagaagugucacuagaa

SEQ ID NO: 18256 - RNA, 19 nt, artificial
  Chemically synthesized
gagacaucgauucacuuca

SEQ ID NO: 18257 - RNA, 19 nt, artificial
  Chemically synthesized
gguggagggagcaagugaa

SEQ ID NO: 18258 - RNA, 19 nt, artificial
  Chemically synthesized
cuaguucuagaaagagaaa

SEQ ID NO: 18259 - RNA, 19 nt, artificial
  Chemically synthesized
gccucggauucccacaaau

SEQ ID NO: 18260 - RNA, 19 nt, artificial
  Chemically synthesized
cauaggaaguccuucuaaa

SEQ ID NO: 18261 - RNA, 19 nt, artificial
  Chemically synthesized
cacagaaacuuaaggcuga

SEQ ID NO: 18262 - RNA, 19 nt, artificial
  Chemically synthesized
aguuuguuguugaacugaa

SEQ ID NO: 18263 - RNA, 19 nt, artificial
  Chemically synthesized
cuguauuccuuauaggaca

SEQ ID NO: 18264 - RNA, 19 nt, artificial
  Chemically synthesized
ggccucggauucccacaaa

SEQ ID NO: 18265 - RNA, 19 nt, artificial
  Chemically synthesized
ggacaggcaagguuucauu

SEQ ID NO: 18266 - RNA, 19 nt, artificial
  Chemically synthesized
ccucuuuugcugaaaaaaa

SEQ ID NO: 18267 - RNA, 19 nt, artificial
  Chemically synthesized
ccuaagaagaccauggaga

SEQ ID NO: 18268 - RNA, 19 nt, artificial
  Chemically synthesized
ggcugcuccaugaggucaa

SEQ ID NO: 18269 - RNA, 19 nt, artificial
  Chemically synthesized
cccucucacuucucccuau

SEQ ID NO: 18270 - RNA, 19 nt, artificial
  Chemically synthesized
ggaagaugcagucagcacu

SEQ ID NO: 18271 - RNA, 19 nt, artificial
  Chemically synthesized
gggcaucaggagaaagcaa

SEQ ID NO: 18272 - RNA, 19 nt, artificial
  Chemically synthesized
ccagagacaucgauucacu

SEQ ID NO: 18273 - RNA, 19 nt, artificial
  Chemically synthesized
ggcaguagucgcuggagca

SEQ ID NO: 18274 - RNA, 19 nt, artificial
  Chemically synthesized
gcccauggaugcugugaca

SEQ ID NO: 18275 - RNA, 19 nt, artificial
  Chemically synthesized
gggacauccucugucacua

SEQ ID NO: 18276 - RNA, 19 nt, artificial
  Chemically synthesized
cuaucucuaguucuagaaa

SEQ ID NO: 18277 - RNA, 19 nt, artificial
  Chemically synthesized
caggcaagguuucauucau

SEQ ID NO: 18278 - RNA, 19 nt, artificial
  Chemically synthesized
ugcugaagaagcccaagaa

SEQ ID NO: 18279 - RNA, 19 nt, artificial
  Chemically synthesized
cugggaagaaucaccauuu

SEQ ID NO: 18280 - RNA, 19 nt, artificial
  Chemically synthesized
gagugacaguggcaguagu

SEQ ID NO: 18281 - RNA, 19 nt, artificial
  Chemically synthesized
ccagccuuucacaggagaa

SEQ ID NO: 18282 - RNA, 19 nt, artificial
  Chemically synthesized
cagucaccaucuucaccuu

SEQ ID NO: 18283 - RNA, 19 nt, artificial
  Chemically synthesized
ucuaguucuagaaagagaa

SEQ ID NO: 18284 - RNA, 19 nt, artificial
  Chemically synthesized
ggagaaagcaacaagaauc

SEQ ID NO: 18285 - RNA, 19 nt, artificial
  Chemically synthesized
gugccauuaaagacacaaa

SEQ ID NO: 18286 - RNA, 19 nt, artificial
  Chemically synthesized
cuuucacagucaccaucuu

SEQ ID NO: 18287 - RNA, 19 nt, artificial
  Chemically synthesized
ccuucaccugagaucacaa

SEQ ID NO: 18288 - RNA, 19 nt, artificial
  Chemically synthesized
agcagagaacaguuccuca

SEQ ID NO: 18289 - RNA, 19 nt, artificial
  Chemically synthesized
ucaguaaguuuguuguuga

SEQ ID NO: 18290 - RNA, 19 nt, artificial
  Chemically synthesized
ggagcagagaacaguuccu

SEQ ID NO: 18291 - RNA, 19 nt, artificial
  Chemically synthesized
ccugauggcugcuccauga

SEQ ID NO: 18292 - RNA, 19 nt, artificial
  Chemically synthesized
cgcagauccaccaaagaga

SEQ ID NO: 18293 - RNA, 19 nt, artificial
  Chemically synthesized
ggagcaaagacuaugacgu

SEQ ID NO: 18294 - RNA, 19 nt, artificial
  Chemically synthesized
aucucuaguucuagaaaga

SEQ ID NO: 18295 - RNA, 19 nt, artificial
  Chemically synthesized
guaaguuuguuguugaacu

SEQ ID NO: 18296 - RNA, 19 nt, artificial
  Chemically synthesized
gacaucgauucacuucaaa

SEQ ID NO: 18297 - RNA, 19 nt, artificial
  Chemically synthesized
gugucacuagaauacuaca

SEQ ID NO: 18298 - RNA, 19 nt, artificial
  Chemically synthesized
guuccucuucccagagaca

SEQ ID NO: 18299 - RNA, 19 nt, artificial
  Chemically synthesized
caguagucgcuggagcaaa

SEQ ID NO: 18300 - RNA, 19 nt, artificial
  Chemically synthesized
aggcucugcuccacagaaa

SEQ ID NO: 18301 - RNA, 19 nt, artificial
  Chemically synthesized
cucuguuccucuucccaga

SEQ ID NO: 18302 - RNA, 19 nt, artificial
  Chemically synthesized
cauuaaagacacaaaccua

SEQ ID NO: 18303 - RNA, 19 nt, artificial
  Chemically synthesized
agcgaugcuucacagccua

SEQ ID NO: 18304 - RNA, 19 nt, artificial
  Chemically synthesized
gggaagaaucaccauuuuu

SEQ ID NO: 18305 - RNA, 19 nt, artificial
  Chemically synthesized
cccugcugaagaagcccaa

SEQ ID NO: 18306 - RNA, 19 nt, artificial
  Chemically synthesized
caggagaagugucacuaga

SEQ ID NO: 18307 - RNA, 19 nt, artificial
  Chemically synthesized
gauucauguacuacgucga

SEQ ID NO: 18308 - RNA, 19 nt, artificial
  Chemically synthesized
gucgcuggagcaaagacua

SEQ ID NO: 18309 - RNA, 19 nt, artificial
  Chemically synthesized
gcaucaggagaaagcaaca

SEQ ID NO: 18310 - RNA, 19 nt, artificial
  Chemically synthesized
cccucuuuugcugaaaaaa

SEQ ID NO: 18311 - RNA, 19 nt, artificial
  Chemically synthesized
ggccagguggagcagagaa

SEQ ID NO: 18312 - RNA, 19 nt, artificial
  Chemically synthesized
agaugacuguauuccuuau

SEQ ID NO: 18313 - RNA, 19 nt, artificial
  Chemically synthesized
ggcaagguuucauucaucu

SEQ ID NO: 18314 - RNA, 19 nt, artificial
  Chemically synthesized
gcaagaagccuagauugca

SEQ ID NO: 18315 - RNA, 19 nt, artificial
  Chemically synthesized
ccauuuuucuucuggcaga

SEQ ID NO: 18316 - RNA, 19 nt, artificial
  Chemically synthesized
ggcucaggguucaaugccu

SEQ ID NO: 18317 - RNA, 19 nt, artificial
  Chemically synthesized
aucuguucucaguaaguuu

SEQ ID NO: 18318 - RNA, 19 nt, artificial
  Chemically synthesized
caucgauucacuucaaaga

SEQ ID NO: 18319 - RNA, 19 nt, artificial
  Chemically synthesized
ccagguggagcagagaaca

SEQ ID NO: 18320 - RNA, 19 nt, artificial
  Chemically synthesized
cauucaucuguucucagua

SEQ ID NO: 18321 - RNA, 19 nt, artificial
  Chemically synthesized
gcaagugaagagaugggaa

SEQ ID NO: 18322 - RNA, 19 nt, artificial
  Chemically synthesized
auucaucuguucucaguaa

SEQ ID NO: 18323 - RNA, 19 nt, artificial
  Chemically synthesized
aagugucacuagaauacua

SEQ ID NO: 18324 - RNA, 19 nt, artificial
  Chemically synthesized
agugaagcuagaaacagaa

SEQ ID NO: 18325 - RNA, 19 nt, artificial
  Chemically synthesized
cagagacaucgauucacuu

SEQ ID NO: 18326 - RNA, 19 nt, artificial
  Chemically synthesized
ggaacugggcacuggcgua

SEQ ID NO: 18327 - RNA, 19 nt, artificial
  Chemically synthesized
ggcuaaagcugauacuuuc

SEQ ID NO: 18328 - RNA, 19 nt, artificial
  Chemically synthesized
ggagcuucaucaguggucu

SEQ ID NO: 18329 - RNA, 19 nt, artificial
  Chemically synthesized
gugacaucugggagcuuca

SEQ ID NO: 18330 - RNA, 19 nt, artificial
  Chemically synthesized
cagccuaccucacaggaca

SEQ ID NO: 18331 - RNA, 19 nt, artificial
  Chemically synthesized
cugcuccacagaaacuuaa

SEQ ID NO: 18332 - RNA, 19 nt, artificial
  Chemically synthesized
ccaugaggaagccagaaau

SEQ ID NO: 18333 - RNA, 19 nt, artificial
  Chemically synthesized
cugaucagcaagaagccua

SEQ ID NO: 18334 - RNA, 19 nt, artificial
  Chemically synthesized
agcuccgauucauguacua

SEQ ID NO: 18335 - RNA, 19 nt, artificial
  Chemically synthesized
aggaagugguacugaucaa

SEQ ID NO: 18336 - RNA, 19 nt, artificial
  Chemically synthesized
gggcucccuaagaagacca

SEQ ID NO: 18337 - RNA, 19 nt, artificial
  Chemically synthesized
ggcucccuaagaagaccau

SEQ ID NO: 18338 - RNA, 19 nt, artificial
  Chemically synthesized
cuucccagagacaucgauu

SEQ ID NO: 18339 - RNA, 19 nt, artificial
  Chemically synthesized
gccuagaggccauucugaa

SEQ ID NO: 18340 - RNA, 19 nt, artificial
  Chemically synthesized
cagucagcacugcacugua

SEQ ID NO: 18341 - RNA, 19 nt, artificial
  Chemically synthesized
cagaaacuuaaggcugaaa

SEQ ID NO: 18342 - RNA, 19 nt, artificial
  Chemically synthesized
cuagaagccuagaggccau

SEQ ID NO: 18343 - RNA, 19 nt, artificial
  Chemically synthesized
ggcguacacugguaucccu

SEQ ID NO: 18344 - RNA, 19 nt, artificial
  Chemically synthesized
ggugcaaguaccagaugcu

SEQ ID NO: 18345 - RNA, 19 nt, artificial
  Chemically synthesized
cucaguugacacuuguuau

SEQ ID NO: 18346 - RNA, 19 nt, artificial
  Chemically synthesized
cccggaaauuggagugaag

SEQ ID NO: 18347 - RNA, 19 nt, artificial
  Chemically synthesized
gggccucggauucccacaa

SEQ ID NO: 18348 - RNA, 19 nt, artificial
  Chemically synthesized
gccuucaccugagaucaca

SEQ ID NO: 18349 - RNA, 19 nt, artificial
  Chemically synthesized
gcuagaaacagaaaaccca

SEQ ID NO: 18350 - RNA, 19 nt, artificial
  Chemically synthesized
uggucaugcugagcucaua

SEQ ID NO: 18351 - RNA, 19 nt, artificial
  Chemically synthesized
guuguugaacugaaaugaa

SEQ ID NO: 18352 - RNA, 19 nt, artificial
  Chemically synthesized
ccuuuggacugggaagaau

SEQ ID NO: 18353 - RNA, 19 nt, artificial
  Chemically synthesized
cacccaucaggcuuccauu

SEQ ID NO: 18354 - RNA, 19 nt, artificial
  Chemically synthesized
ggcagaugacuguauuccu

SEQ ID NO: 18355 - RNA, 19 nt, artificial
  Chemically synthesized
ggugguaggaagugguacu

SEQ ID NO: 18356 - RNA, 19 nt, artificial
  Chemically synthesized
cuaagaagaccauggagag

SEQ ID NO: 18357 - RNA, 19 nt, artificial
  Chemically synthesized
cuaggaaagccaugaggaa

SEQ ID NO: 18358 - RNA, 19 nt, artificial
  Chemically synthesized
ccugacugaucagcaagaa

SEQ ID NO: 18359 - RNA, 19 nt, artificial
  Chemically synthesized
agguauagggagugaguca

SEQ ID NO: 18360 - RNA, 19 nt, artificial
  Chemically synthesized
cccaggaccuggucuccua

SEQ ID NO: 18361 - RNA, 19 nt, artificial
  Chemically synthesized
gcaacaagaauccaguccu

SEQ ID NO: 18362 - RNA, 19 nt, artificial
  Chemically synthesized
cggaaauuggagugaagcu

SEQ ID NO: 18363 - RNA, 19 nt, artificial
  Chemically synthesized
aggagaaagcaacaagaau

SEQ ID NO: 18364 - RNA, 19 nt, artificial
  Chemically synthesized
ccaucuucaccuuuggacu

SEQ ID NO: 18365 - RNA, 19 nt, artificial
  Chemically synthesized
cggauucccacaaauguga

SEQ ID NO: 18366 - RNA, 19 nt, artificial
  Chemically synthesized
cacucaguugacacuuguu

SEQ ID NO: 18367 - RNA, 19 nt, artificial
  Chemically synthesized
ccaucaggcuuccauuacu

SEQ ID NO: 18368 - RNA, 19 nt, artificial
  Chemically synthesized
gacuguauuccuuauagga

SEQ ID NO: 18369 - RNA, 19 nt, artificial
  Chemically synthesized
cacgcuauggcaucaucga

SEQ ID NO: 18370 - RNA, 19 nt, artificial
  Chemically synthesized
agccuuucacaggagaagu

SEQ ID NO: 18371 - RNA, 19 nt, artificial
  Chemically synthesized
gcuccaugaggucaagacu

SEQ ID NO: 18372 - RNA, 19 nt, artificial
  Chemically synthesized
cacacaugcgagugacagu

SEQ ID NO: 18373 - RNA, 19 nt, artificial
  Chemically synthesized
uggagugaagcuagaaaca

SEQ ID NO: 18374 - RNA, 19 nt, artificial
  Chemically synthesized
caggcucugcuccacagaa

SEQ ID NO: 18375 - RNA, 19 nt, artificial
  Chemically synthesized
caguugcucugccagccuu

SEQ ID NO: 18376 - RNA, 19 nt, artificial
  Chemically synthesized
gggaucagagcacccauca

SEQ ID NO: 18377 - RNA, 19 nt, artificial
  Chemically synthesized
caagugaagagaugggaau

SEQ ID NO: 18378 - RNA, 19 nt, artificial
  Chemically synthesized
gcagaugacuguauuccuu

SEQ ID NO: 18379 - RNA, 19 nt, artificial
  Chemically synthesized
cccacacaugcgagugaca

SEQ ID NO: 18380 - RNA, 19 nt, artificial
  Chemically synthesized
cacugguaucccuccuaaa

SEQ ID NO: 18381 - RNA, 19 nt, artificial
  Chemically synthesized
cucggauucccacaaaugu

SEQ ID NO: 18382 - RNA, 19 nt, artificial
  Chemically synthesized
cgcgcagcccucaucgcaa

SEQ ID NO: 18383 - RNA, 19 nt, artificial
  Chemically synthesized
gccagaaauuggagguggu

SEQ ID NO: 18384 - RNA, 19 nt, artificial
  Chemically synthesized
ugaagcuagaaacagaaaa

SEQ ID NO: 18385 - RNA, 19 nt, artificial
  Chemically synthesized
gcacugcacuguauuuuuu

SEQ ID NO: 18386 - RNA, 19 nt, artificial
  Chemically synthesized
ucugcuccacagaaacuua

SEQ ID NO: 18387 - RNA, 19 nt, artificial
  Chemically synthesized
gcaaguaccagaugcugca

SEQ ID NO: 18388 - RNA, 19 nt, artificial
  Chemically synthesized
gggagcaagugaagagaug

SEQ ID NO: 18389 - RNA, 19 nt, artificial
  Chemically synthesized
cauggaugcugugacaucu

SEQ ID NO: 18390 - RNA, 19 nt, artificial
  Chemically synthesized
cagcaagaagccuagauug

SEQ ID NO: 18391 - RNA, 19 nt, artificial
  Chemically synthesized
cccuggugcaaguaccaga

SEQ ID NO: 18392 - RNA, 19 nt, artificial
  Chemically synthesized
agcucagucacgucuccca

SEQ ID NO: 18393 - RNA, 19 nt, artificial
  Chemically synthesized
gccagccuuucacaggaga

SEQ ID NO: 18394 - RNA, 19 nt, artificial
  Chemically synthesized
ggauggucuuccuaguugc

SEQ ID NO: 18395 - RNA, 19 nt, artificial
  Chemically synthesized
cuccuaaagaagugacuca

SEQ ID NO: 18396 - RNA, 19 nt, artificial
  Chemically synthesized
ucaucaguggucuggcuaa

SEQ ID NO: 18397 - RNA, 19 nt, artificial
  Chemically synthesized
ccaccugagcuccgauuca

SEQ ID NO: 18398 - RNA, 19 nt, artificial
  Chemically synthesized
ggugguggagggagcaagu

SEQ ID NO: 18399 - RNA, 19 nt, artificial
  Chemically synthesized
gucacuacggccuuacaua

SEQ ID NO: 18400 - RNA, 19 nt, artificial
  Chemically synthesized
ccaugcagggccucggauu

SEQ ID NO: 18401 - RNA, 19 nt, artificial
  Chemically synthesized
gccacagugaggaagaccu

SEQ ID NO: 18402 - RNA, 19 nt, artificial
  Chemically synthesized
gccucaccauggauggucu

SEQ ID NO: 18403 - RNA, 19 nt, artificial
  Chemically synthesized
uguucucaguaaguuuguu

SEQ ID NO: 18404 - RNA, 19 nt, artificial
  Chemically synthesized
caucaguggucuggcuaaa

SEQ ID NO: 18405 - RNA, 19 nt, artificial
  Chemically synthesized
ggacugggaagaaucacca

SEQ ID NO: 18406 - RNA, 19 nt, artificial
  Chemically synthesized
cucuucccagagacaucga

SEQ ID NO: 18407 - RNA, 19 nt, artificial
  Chemically synthesized
agguggagcagagaacagu

SEQ ID NO: 18408 - RNA, 19 nt, artificial
  Chemically synthesized
ggccaugaggaagccagaa

SEQ ID NO: 18409 - RNA, 19 nt, artificial
  Chemically synthesized
cugcugaagaagcccaaga

SEQ ID NO: 18410 - RNA, 19 nt, artificial
  Chemically synthesized
cagaugacuguauuccuua

SEQ ID NO: 18411 - RNA, 19 nt, artificial
  Chemically synthesized
gcuguagggaagaugcagu

SEQ ID NO: 18412 - RNA, 19 nt, artificial
  Chemically synthesized
ggucaagacugggucuccu

SEQ ID NO: 18413 - RNA, 19 nt, artificial
  Chemically synthesized
ggcucugcuccacagaaac

SEQ ID NO: 18414 - RNA, 19 nt, artificial
  Chemically synthesized
cagcgaugcuucacagccu

SEQ ID NO: 18415 - RNA, 19 nt, artificial
  Chemically synthesized
agcccaagaagaggcccaa

SEQ ID NO: 18416 - RNA, 19 nt, artificial
  Chemically synthesized
ccuaagaagccucuaggca

SEQ ID NO: 18417 - RNA, 19 nt, artificial
  Chemically synthesized
gcucaggguucaaugccuu

SEQ ID NO: 18418 - RNA, 19 nt, artificial
  Chemically synthesized
agagaacaguuccucagcu

SEQ ID NO: 18419 - RNA, 19 nt, artificial
  Chemically synthesized
cauggauggucuuccuagu

SEQ ID NO: 18420 - RNA, 19 nt, artificial
  Chemically synthesized
ccugagaucacaagcccau

SEQ ID NO: 18421 - RNA, 19 nt, artificial
  Chemically synthesized
ggaagaaucaccauuuuuc

SEQ ID NO: 18422 - RNA, 19 nt, artificial
  Chemically synthesized
aaaugugacaagagguaua

SEQ ID NO: 18423 - RNA, 19 nt, artificial
  Chemically synthesized
acccaucaggcuuccauua

SEQ ID NO: 18424 - RNA, 19 nt, artificial
  Chemically synthesized
cgcgcgcagauccaccaaa

SEQ ID NO: 18425 - RNA, 19 nt, artificial
  Chemically synthesized
caaagaagcugucaugcgu

SEQ ID NO: 18426 - RNA, 19 nt, artificial
  Chemically synthesized
caucuguucucaguaaguu

SEQ ID NO: 18427 - RNA, 19 nt, artificial
  Chemically synthesized
cuagaaacagaaaacccau

SEQ ID NO: 18428 - RNA, 19 nt, artificial
  Chemically synthesized
cucucacuucucccuauca

SEQ ID NO: 18429 - RNA, 19 nt, artificial
  Chemically synthesized
ccuagaggccauucugaau

SEQ ID NO: 18430 - RNA, 19 nt, artificial
  Chemically synthesized
ugcagacacucaguugaca

SEQ ID NO: 18431 - RNA, 19 nt, artificial
  Chemically synthesized
ggagugagucacagcgcuu

SEQ ID NO: 18432 - RNA, 19 nt, artificial
  Chemically synthesized
agcacugcacuguauuuuu

SEQ ID NO: 18433 - RNA, 19 nt, artificial
  Chemically synthesized
gggagugagucacagcgcu

SEQ ID NO: 18434 - RNA, 19 nt, artificial
  Chemically synthesized
cgauucacuucaaagagcu

SEQ ID NO: 18435 - RNA, 19 nt, artificial
  Chemically synthesized
cguuaucugcagacacuca

SEQ ID NO: 18436 - RNA, 19 nt, artificial
  Chemically synthesized
ccuccaauguguacuuuug

SEQ ID NO: 18437 - RNA, 19 nt, artificial
  Chemically synthesized
acauaggaaguccuucuaa

SEQ ID NO: 18438 - RNA, 19 nt, artificial
  Chemically synthesized
cagacacucaguugacacu

SEQ ID NO: 18439 - RNA, 19 nt, artificial
  Chemically synthesized
cacugcacuguauuuuuua

SEQ ID NO: 18440 - RNA, 19 nt, artificial
  Chemically synthesized
cacaggagaagugucacua

SEQ ID NO: 18441 - RNA, 19 nt, artificial
  Chemically synthesized
gugaagagaugggaaucca

SEQ ID NO: 18442 - RNA, 19 nt, artificial
  Chemically synthesized
gaugacuguauuccuuaua

SEQ ID NO: 18443 - RNA, 19 nt, artificial
  Chemically synthesized
auuggagugaagcuagaaa

SEQ ID NO: 18444 - RNA, 19 nt, artificial
  Chemically synthesized
caugaggaagccagaaauu

SEQ ID NO: 18445 - RNA, 19 nt, artificial
  Chemically synthesized
gcggcgcuauaguguccga

SEQ ID NO: 18446 - RNA, 19 nt, artificial
  Chemically synthesized
aagguuucauucaucuguu

SEQ ID NO: 18447 - RNA, 19 nt, artificial
  Chemically synthesized
ugggaagaaucaccauuuu

SEQ ID NO: 18448 - RNA, 19 nt, artificial
  Chemically synthesized
ugcuucacagccuaccuca

SEQ ID NO: 18449 - RNA, 19 nt, artificial
  Chemically synthesized
cucuaggcaagauggcuga

SEQ ID NO: 18450 - RNA, 19 nt, artificial
  Chemically synthesized
gacaagagguauagggagu

SEQ ID NO: 18451 - RNA, 19 nt, artificial
  Chemically synthesized
ggugccauuaaagacacaa

SEQ ID NO: 18452 - RNA, 19 nt, artificial
  Chemically synthesized
agucagcacugcacuguau

SEQ ID NO: 18453 - RNA, 19 nt, artificial
  Chemically synthesized
gcuauaguguccgagcugu

SEQ ID NO: 18454 - RNA, 19 nt, artificial
  Chemically synthesized
gcagagaacaguuccucag

SEQ ID NO: 18455 - RNA, 19 nt, artificial
  Chemically synthesized
cuguucucaguaaguuugu

SEQ ID NO: 18456 - RNA, 19 nt, artificial
  Chemically synthesized
ccucggauucccacaaaug

SEQ ID NO: 18457 - RNA, 19 nt, artificial
  Chemically synthesized
agccuagaggccauucuga

SEQ ID NO: 18458 - RNA, 19 nt, artificial
  Chemically synthesized
gcuccuggcucucggccua

SEQ ID NO: 18459 - RNA, 19 nt, artificial
  Chemically synthesized
ucuaucucuaguucuagaa

SEQ ID NO: 18460 - RNA, 19 nt, artificial
  Chemically synthesized
auccaguccuucacacuca

SEQ ID NO: 18461 - RNA, 19 nt, artificial
  Chemically synthesized
gucaagucaaagaagcugu

SEQ ID NO: 18462 - RNA, 19 nt, artificial
  Chemically synthesized
ucugcagacacucaguuga

SEQ ID NO: 18463 - RNA, 19 nt, artificial
  Chemically synthesized
accugagaucacaagccca

SEQ ID NO: 18464 - RNA, 19 nt, artificial
  Chemically synthesized
gagggagcaagugaagaga

SEQ ID NO: 18465 - RNA, 19 nt, artificial
  Chemically synthesized
ucagcaagaagccuagauu

SEQ ID NO: 18466 - RNA, 19 nt, artificial
  Chemically synthesized
gcgcuauaguguccgagcu

SEQ ID NO: 18467 - RNA, 19 nt, artificial
  Chemically synthesized
gauacuuucacagucacca

SEQ ID NO: 18468 - RNA, 19 nt, artificial
  Chemically synthesized
gaaucaccauuuuucuucu

SEQ ID NO: 18469 - RNA, 19 nt, artificial
  Chemically synthesized
gcugacugguucaggcaga

SEQ ID NO: 18470 - RNA, 19 nt, artificial
  Chemically synthesized
agugguacugaucaaugau

SEQ ID NO: 18471 - RNA, 19 nt, artificial
  Chemically synthesized
gcuauggcaucaucgaccu

SEQ ID NO: 18472 - RNA, 19 nt, artificial
  Chemically synthesized
cucacaggacagcccacua

SEQ ID NO: 18473 - RNA, 19 nt, artificial
  Chemically synthesized
caugcgagugacaguggca

SEQ ID NO: 18474 - RNA, 19 nt, artificial
  Chemically synthesized
agcugauacuuucacaguc

SEQ ID NO: 18475 - RNA, 19 nt, artificial
  Chemically synthesized
ccuucacacucacacuacu

SEQ ID NO: 18476 - RNA, 19 nt, artificial
  Chemically synthesized
agaagccucuaggcaagau

SEQ ID NO: 18477 - RNA, 19 nt, artificial
  Chemically synthesized
agggagcaagugaagagau

SEQ ID NO: 18478 - RNA, 19 nt, artificial
  Chemically synthesized
cuguuccucuucccagaga

SEQ ID NO: 18479 - RNA, 19 nt, artificial
  Chemically synthesized
gcugaagaagcccaagaag

SEQ ID NO: 18480 - RNA, 19 nt, artificial
  Chemically synthesized
gaagaaucaccauuuuucu

SEQ ID NO: 18481 - RNA, 19 nt, artificial
  Chemically synthesized
gagugagucacagcgcuuu

SEQ ID NO: 18482 - RNA, 19 nt, artificial
  Chemically synthesized
gccuuacauaggaaguccu

SEQ ID NO: 18483 - RNA, 19 nt, artificial
  Chemically synthesized
cugggaucagagcacccau

SEQ ID NO: 18484 - RNA, 19 nt, artificial
  Chemically synthesized
cucaguaaguuuguuguug

SEQ ID NO: 18485 - RNA, 19 nt, artificial
  Chemically synthesized
caccauuuuucuucuggca

SEQ ID NO: 18486 - RNA, 19 nt, artificial
  Chemically synthesized
cacccacacaugcgaguga

SEQ ID NO: 18487 - RNA, 19 nt, artificial
  Chemically synthesized
auuauuuccuccaaugugu

SEQ ID NO: 18488 - RNA, 19 nt, artificial
  Chemically synthesized
ucaccugacugaucagcaa

SEQ ID NO: 18489 - RNA, 19 nt, artificial
  Chemically synthesized
ccuccagcgaugcuucaca

SEQ ID NO: 18490 - RNA, 19 nt, artificial
  Chemically synthesized
ccuggugcaaguaccagau

SEQ ID NO: 18491 - RNA, 19 nt, artificial
  Chemically synthesized
agaucacaagcccauggau

SEQ ID NO: 18492 - RNA, 19 nt, artificial
  Chemically synthesized
ucccagagacaucgauuca

SEQ ID NO: 18493 - RNA, 19 nt, artificial
  Chemically synthesized
gaagugucacuagaauacu

SEQ ID NO: 18494 - RNA, 19 nt, artificial
  Chemically synthesized
gccagguggagcagagaac

SEQ ID NO: 18495 - RNA, 19 nt, artificial
  Chemically synthesized
cuggcucucggccuaagaa

SEQ ID NO: 18496 - RNA, 19 nt, artificial
  Chemically synthesized
gacugggaagaaucaccau

SEQ ID NO: 18497 - RNA, 19 nt, artificial
  Chemically synthesized
ggaggugguaggaaguggu

SEQ ID NO: 18498 - RNA, 19 nt, artificial
  Chemically synthesized
gaagcuagaaacagaaaac

SEQ ID NO: 18499 - RNA, 19 nt, artificial
  Chemically synthesized
gaaauuggagugaagcuag

SEQ ID NO: 18500 - RNA, 19 nt, artificial
  Chemically synthesized
gcuaaagcugauacuuuca

SEQ ID NO: 18501 - RNA, 19 nt, artificial
  Chemically synthesized
caagaagccuagauugcag

SEQ ID NO: 18502 - RNA, 19 nt, artificial
  Chemically synthesized
aauuggagugaagcuagaa

SEQ ID NO: 18503 - RNA, 19 nt, artificial
  Chemically synthesized
gagcuguagggaagaugca

SEQ ID NO: 18504 - RNA, 19 nt, artificial
  Chemically synthesized
ucucaguaaguuuguuguu

SEQ ID NO: 18505 - RNA, 19 nt, artificial
  Chemically synthesized
uucuaucucuaguucuaga

SEQ ID NO: 18506 - RNA, 19 nt, artificial
  Chemically synthesized
auacuuucacagucaccau

SEQ ID NO: 18507 - RNA, 19 nt, artificial
  Chemically synthesized
gagaacaguuccucagcug

SEQ ID NO: 18508 - RNA, 19 nt, artificial
  Chemically synthesized
gacacaaaccuagaagccu

SEQ ID NO: 18509 - RNA, 19 nt, artificial
  Chemically synthesized
caagguuucauucaucugu

SEQ ID NO: 18510 - RNA, 19 nt, artificial
  Chemically synthesized
agaagugacucaccugacu

SEQ ID NO: 18511 - RNA, 19 nt, artificial
  Chemically synthesized
gggugguggagggagcaag

SEQ ID NO: 18512 - RNA, 19 nt, artificial
  Chemically synthesized
ccucccagcuccuggcucu

SEQ ID NO: 18513 - RNA, 19 nt, artificial
  Chemically synthesized
ccuagaagccuagaggcca

SEQ ID NO: 18514 - RNA, 19 nt, artificial
  Chemically synthesized
ccauuaaagacacaaaccu

SEQ ID NO: 18515 - RNA, 19 nt, artificial
  Chemically synthesized
aggcaagguuucauucauc

SEQ ID NO: 18516 - RNA, 19 nt, artificial
  Chemically synthesized
cagucacgucucccagccu

SEQ ID NO: 18517 - RNA, 19 nt, artificial
  Chemically synthesized
aggcagacccugcugaaga

SEQ ID NO: 18518 - RNA, 19 nt, artificial
  Chemically synthesized
gaucagcaagaagccuaga

SEQ ID NO: 18519 - RNA, 19 nt, artificial
  Chemically synthesized
gaugcuucacagccuaccu

SEQ ID NO: 18520 - RNA, 19 nt, artificial
  Chemically synthesized
ggcacugagcaguagucac

SEQ ID NO: 18521 - RNA, 19 nt, artificial
  Chemically synthesized
ccuaggaaagccaugagga

SEQ ID NO: 18522 - RNA, 19 nt, artificial
  Chemically synthesized
gcacugagcaguagucacu

SEQ ID NO: 18523 - RNA, 19 nt, artificial
  Chemically synthesized
caccuuuggacugggaaga

SEQ ID NO: 18524 - RNA, 19 nt, artificial
  Chemically synthesized
acaucugggagcuucauca

SEQ ID NO: 18525 - RNA, 19 nt, artificial
  Chemically synthesized
gaugcugugacaucuggga

SEQ ID NO: 18526 - RNA, 19 nt, artificial
  Chemically synthesized
gcccugugccaguugcucu

SEQ ID NO: 18527 - RNA, 19 nt, artificial
  Chemically synthesized
guauagggagugagucaca

SEQ ID NO: 18528 - RNA, 19 nt, artificial
  Chemically synthesized
ccuuacauaggaaguccuu

SEQ ID NO: 18529 - RNA, 19 nt, artificial
  Chemically synthesized
cuuuggacugggaagaauc

SEQ ID NO: 18530 - RNA, 19 nt, artificial
  Chemically synthesized
gggaagaugcagucagcac

SEQ ID NO: 18531 - RNA, 19 nt, artificial
  Chemically synthesized
ggagcaagugaagagaugg

SEQ ID NO: 18532 - RNA, 19 nt, artificial
  Chemically synthesized
ugcgcugcuuccugcaacu

SEQ ID NO: 18533 - RNA, 19 nt, artificial
  Chemically synthesized
gcucugccagccuuucaca

SEQ ID NO: 18534 - RNA, 19 nt, artificial
  Chemically synthesized
uauaggacaggcaagguuu

SEQ ID NO: 18535 - RNA, 19 nt, artificial
  Chemically synthesized
acugugggcucccuaagaa

SEQ ID NO: 18536 - RNA, 19 nt, artificial
  Chemically synthesized
acaggcaagguuucauuca

SEQ ID NO: 18537 - RNA, 19 nt, artificial
  Chemically synthesized
ggcaucaggagaaagcaac

SEQ ID NO: 18538 - RNA, 19 nt, artificial
  Chemically synthesized
gguuucauucaucuguucu

SEQ ID NO: 18539 - RNA, 19 nt, artificial
  Chemically synthesized
uaagaagccucuaggcaag

SEQ ID NO: 18540 - RNA, 19 nt, artificial
  Chemically synthesized
ugugggcucccuaagaaga

SEQ ID NO: 18541 - RNA, 19 nt, artificial
  Chemically synthesized
cgcgcagauccaccaaaga

SEQ ID NO: 18542 - RNA, 19 nt, artificial
  Chemically synthesized
cuuucacaggagaaguguc

SEQ ID NO: 18543 - RNA, 19 nt, artificial
  Chemically synthesized
aguugcucugccagccuuu

SEQ ID NO: 18544 - RNA, 19 nt, artificial
  Chemically synthesized
uccucuucccagagacauc

SEQ ID NO: 18545 - RNA, 19 nt, artificial
  Chemically synthesized
gguucaggcagacccugcu

SEQ ID NO: 18546 - RNA, 19 nt, artificial
  Chemically synthesized
cacaaaugugacaagaggu

SEQ ID NO: 18547 - RNA, 19 nt, artificial
  Chemically synthesized
aacuuaaggcugaaagagu

SEQ ID NO: 18548 - RNA, 19 nt, artificial
  Chemically synthesized
ggaucagagcacccaucag

SEQ ID NO: 18549 - RNA, 19 nt, artificial
  Chemically synthesized
ugcgagugacaguggcagu

SEQ ID NO: 18550 - RNA, 19 nt, artificial
  Chemically synthesized
agacacucaguugacacuu

SEQ ID NO: 18551 - RNA, 19 nt, artificial
  Chemically synthesized
caaagagcuguagggaaga

SEQ ID NO: 18552 - RNA, 19 nt, artificial
  Chemically synthesized
cugguaucccuccuaaaga

SEQ ID NO: 18553 - RNA, 19 nt, artificial
  Chemically synthesized
guccuucacacucacacua

SEQ ID NO: 18554 - RNA, 19 nt, artificial
  Chemically synthesized
accuuuggacugggaagaa

SEQ ID NO: 18555 - RNA, 19 nt, artificial
  Chemically synthesized
ggccuaagaagccucuagg

SEQ ID NO: 18556 - RNA, 19 nt, artificial
  Chemically synthesized
uguuguugaacugaaauga

SEQ ID NO: 18557 - RNA, 19 nt, artificial
  Chemically synthesized
gagaucacaagcccaugga

SEQ ID NO: 18558 - RNA, 19 nt, artificial
  Chemically synthesized
cuaggugccauuaaagaca

SEQ ID NO: 18559 - RNA, 19 nt, artificial
  Chemically synthesized
cucacuucucccuaucaug

SEQ ID NO: 18560 - RNA, 19 nt, artificial
  Chemically synthesized
accugacugaucagcaaga

SEQ ID NO: 18561 - RNA, 19 nt, artificial
  Chemically synthesized
agaagugucacuagaauac

SEQ ID NO: 18562 - RNA, 19 nt, artificial
  Chemically synthesized
agcaaagacuaugacgucu

SEQ ID NO: 18563 - RNA, 19 nt, artificial
  Chemically synthesized
uccgauucauguacuacgu

SEQ ID NO: 18564 - RNA, 19 nt, artificial
  Chemically synthesized
gcugcuuccugcaacuccg

SEQ ID NO: 18565 - RNA, 19 nt, artificial
  Chemically synthesized
gccuuucacaggagaagug

SEQ ID NO: 18566 - RNA, 19 nt, artificial
  Chemically synthesized
gaauccaguccuucacacu

SEQ ID NO: 18567 - RNA, 19 nt, artificial
  Chemically synthesized
ggaaguccuucuaaagagc

SEQ ID NO: 18568 - RNA, 19 nt, artificial
  Chemically synthesized
gcuucacagccuaccucac

SEQ ID NO: 18569 - RNA, 19 nt, artificial
  Chemically synthesized
cgccgggcuuccuucagga

SEQ ID NO: 18570 - RNA, 19 nt, artificial
  Chemically synthesized
caaaugugacaagagguau

SEQ ID NO: 18571 - RNA, 19 nt, artificial
  Chemically synthesized
caucaggagaaagcaacaa

SEQ ID NO: 18572 - RNA, 19 nt, artificial
  Chemically synthesized
caguugacacuuguuauau

SEQ ID NO: 18573 - RNA, 19 nt, artificial
  Chemically synthesized
ggagugaagcuagaaacag

SEQ ID NO: 18574 - RNA, 19 nt, artificial
  Chemically synthesized
gucuccuacuuggaaggca

SEQ ID NO: 18575 - RNA, 19 nt, artificial
  Chemically synthesized
ugaagaagcccaagaagag

SEQ ID NO: 18576 - RNA, 19 nt, artificial
  Chemically synthesized
gccucagcucagucacguc

SEQ ID NO: 18577 - RNA, 19 nt, artificial
  Chemically synthesized
gcgcagcccucaucgcaac

SEQ ID NO: 18578 - RNA, 19 nt, artificial
  Chemically synthesized
ccaguccuucacacucaca

SEQ ID NO: 18579 - RNA, 19 nt, artificial
  Chemically synthesized
ccagggcucaggguucaau

SEQ ID NO: 18580 - RNA, 19 nt, artificial
  Chemically synthesized
gcucugcuccacagaaacu

SEQ ID NO: 18581 - RNA, 19 nt, artificial
  Chemically synthesized
cauuuuucuucuggcagau

SEQ ID NO: 18582 - RNA, 19 nt, artificial
  Chemically synthesized
acuuaaggcugaaagagug

SEQ ID NO: 18583 - RNA, 19 nt, artificial
  Chemically synthesized
gagcuccgauucauguacu

SEQ ID NO: 18584 - RNA, 19 nt, artificial
  Chemically synthesized
uggcuaaagcugauacuuu

SEQ ID NO: 18585 - RNA, 19 nt, artificial
  Chemically synthesized
gaauccagggcucaggguu

SEQ ID NO: 18586 - RNA, 19 nt, artificial
  Chemically synthesized
agaugcagucagcacugca

SEQ ID NO: 18587 - RNA, 19 nt, artificial
  Chemically synthesized
ggaagccuggcacccacuu

SEQ ID NO: 18588 - RNA, 19 nt, artificial
  Chemically synthesized
gguucaaugccuucaccug

SEQ ID NO: 18589 - RNA, 19 nt, artificial
  Chemically synthesized
cuacuuggaaggcagcacu

SEQ ID NO: 18590 - RNA, 19 nt, artificial
  Chemically synthesized
gcgcgcagauccaccaaag

SEQ ID NO: 18591 - RNA, 19 nt, artificial
  Chemically synthesized
aguccuucacacucacacu

SEQ ID NO: 18592 - RNA, 19 nt, artificial
  Chemically synthesized
gucagcacugcacuguauu

SEQ ID NO: 18593 - RNA, 19 nt, artificial
  Chemically synthesized
acugggaagaaucaccauu

SEQ ID NO: 18594 - RNA, 19 nt, artificial
  Chemically synthesized
ucagcacugcacuguauuu

SEQ ID NO: 18595 - RNA, 19 nt, artificial
  Chemically synthesized
gugacaagagguauaggga

SEQ ID NO: 18596 - RNA, 19 nt, artificial
  Chemically synthesized
gaaacagaaaacccaugca

SEQ ID NO: 18597 - RNA, 19 nt, artificial
  Chemically synthesized
ccuuucacaggagaagugu

SEQ ID NO: 18598 - RNA, 19 nt, artificial
  Chemically synthesized
agagguauagggagugagu

SEQ ID NO: 18599 - RNA, 19 nt, artificial
  Chemically synthesized
cggccuaagaagccucuag

SEQ ID NO: 18600 - RNA, 19 nt, artificial
  Chemically synthesized
aaagcaacaagaauccagu

SEQ ID NO: 18601 - RNA, 19 nt, artificial
  Chemically synthesized
ugcguuaucugcagacacu

SEQ ID NO: 18602 - RNA, 19 nt, artificial
  Chemically synthesized
guucaaugccuucaccuga

SEQ ID NO: 18603 - RNA, 19 nt, artificial
  Chemically synthesized
ccauggaugcugugacauc

SEQ ID NO: 18604 - RNA, 19 nt, artificial
  Chemically synthesized
gccgggugcugcucaucac

SEQ ID NO: 18605 - RNA, 19 nt, artificial
  Chemically synthesized
aggugccauuaaagacaca

SEQ ID NO: 18606 - RNA, 19 nt, artificial
  Chemically synthesized
ggguucaaugccuucaccu

SEQ ID NO: 18607 - RNA, 19 nt, artificial
  Chemically synthesized
gccucuaggcaagauggcu

SEQ ID NO: 18608 - RNA, 19 nt, artificial
  Chemically synthesized
gcugugacaucugggagcu

SEQ ID NO: 18609 - RNA, 19 nt, artificial
  Chemically synthesized
gagcaaagacuaugacguc

SEQ ID NO: 18610 - RNA, 19 nt, artificial
  Chemically synthesized
ggacauccucugucacuac

SEQ ID NO: 18611 - RNA, 19 nt, artificial
  Chemically synthesized
guggagcagagaacaguuc

SEQ ID NO: 18612 - RNA, 19 nt, artificial
  Chemically synthesized
acaaaugugacaagaggua

SEQ ID NO: 18613 - RNA, 19 nt, artificial
  Chemically synthesized
ggcacuggcguacacuggu

SEQ ID NO: 18614 - RNA, 19 nt, artificial
  Chemically synthesized
cugcaacuccgggaugcaa

SEQ ID NO: 18615 - RNA, 19 nt, artificial
  Chemically synthesized
cuagaggccauucugaaua

SEQ ID NO: 18616 - RNA, 19 nt, artificial
  Chemically synthesized
auuacugugggcucccuaa

SEQ ID NO: 18617 - RNA, 19 nt, artificial
  Chemically synthesized
cccaagaaggccaugagga

SEQ ID NO: 18618 - RNA, 19 nt, artificial
  Chemically synthesized
aggccaugaggaagccaga

SEQ ID NO: 18619 - RNA, 19 nt, artificial
  Chemically synthesized
cacaaaccuagaagccuag

SEQ ID NO: 18620 - RNA, 19 nt, artificial
  Chemically synthesized
cgugugccacagugaggaa

SEQ ID NO: 18621 - RNA, 19 nt, artificial
  Chemically synthesized
cuucaucaguggucuggcu

SEQ ID NO: 18622 - RNA, 19 nt, artificial
  Chemically synthesized
ggagggagcaagugaagag

SEQ ID NO: 18623 - RNA, 19 nt, artificial
  Chemically synthesized
cgauucauguacuacgucg

SEQ ID NO: 18624 - RNA, 19 nt, artificial
  Chemically synthesized
gcugaaagaguguccgcca

SEQ ID NO: 18625 - RNA, 19 nt, artificial
  Chemically synthesized
gaguguccgccaucaggga

SEQ ID NO: 18626 - RNA, 19 nt, artificial
  Chemically synthesized
ugcugagcucauacccuga

SEQ ID NO: 18627 - RNA, 19 nt, artificial
  Chemically synthesized
uucuucagcagggucugcc

SEQ ID NO: 18628 - RNA, 19 nt, artificial
  Chemically synthesized
uauucuagugacacuucuc

SEQ ID NO: 18629 - RNA, 19 nt, artificial
  Chemically synthesized
auucuagugacacuucucc

SEQ ID NO: 18630 - RNA, 19 nt, artificial
  Chemically synthesized
uugccuagaggcuucuuag

SEQ ID NO: 18631 - RNA, 19 nt, artificial
  Chemically synthesized
uucaacaacaaacuuacug

SEQ ID NO: 18632 - RNA, 19 nt, artificial
  Chemically synthesized
aacuguucucugcuccacc

SEQ ID NO: 18633 - RNA, 19 nt, artificial
  Chemically synthesized
uuucaguucaacaacaaac

SEQ ID NO: 18634 - RNA, 19 nt, artificial
  Chemically synthesized
uugaagugaaucgaugucu

SEQ ID NO: 18635 - RNA, 19 nt, artificial
  Chemically synthesized
ucucuuucuagaacuagag

SEQ ID NO: 18636 - RNA, 19 nt, artificial
  Chemically synthesized
aagcucuccauggucuucu

SEQ ID NO: 18637 - RNA, 19 nt, artificial
  Chemically synthesized
ugacugugaaaguaucagc

SEQ ID NO: 18638 - RNA, 19 nt, artificial
  Chemically synthesized
uaggcuucuagguuugugu

SEQ ID NO: 18639 - RNA, 19 nt, artificial
  Chemically synthesized
uucuagugacacuucuccu

SEQ ID NO: 18640 - RNA, 19 nt, artificial
  Chemically synthesized
ugaagugaaucgaugucuc

SEQ ID NO: 18641 - RNA, 19 nt, artificial
  Chemically synthesized
uucacuugcucccuccacc

SEQ ID NO: 18642 - RNA, 19 nt, artificial
  Chemically synthesized
uuucucuuucuagaacuag

SEQ ID NO: 18643 - RNA, 19 nt, artificial
  Chemically synthesized
auuugugggaauccgaggc

SEQ ID NO: 18644 - RNA, 19 nt, artificial
  Chemically synthesized
uuuagaaggacuuccuaug

SEQ ID NO: 18645 - RNA, 19 nt, artificial
  Chemically synthesized
ucagccuuaaguuucugug

SEQ ID NO: 18646 - RNA, 19 nt, artificial
  Chemically synthesized
uucaguucaacaacaaacu

SEQ ID NO: 18647 - RNA, 19 nt, artificial
  Chemically synthesized
uguccuauaaggaauacag

SEQ ID NO: 18648 - RNA, 19 nt, artificial
  Chemically synthesized
uuugugggaauccgaggcc

SEQ ID NO: 18649 - RNA, 19 nt, artificial
  Chemically synthesized
aaugaaaccuugccugucc

SEQ ID NO: 18650 - RNA, 19 nt, artificial
  Chemically synthesized
uuuuuuucagcaaaagagg

SEQ ID NO: 18651 - RNA, 19 nt, artificial
  Chemically synthesized
ucuccauggucuucuuagg

SEQ ID NO: 18652 - RNA, 19 nt, artificial
  Chemically synthesized
uugaccucauggagcagcc

SEQ ID NO: 18653 - RNA, 19 nt, artificial
  Chemically synthesized
auagggagaagugagaggg

SEQ ID NO: 18654 - RNA, 19 nt, artificial
  Chemically synthesized
agugcugacugcaucuucc

SEQ ID NO: 18655 - RNA, 19 nt, artificial
  Chemically synthesized
uugcuuucuccugaugccc

SEQ ID NO: 18656 - RNA, 19 nt, artificial
  Chemically synthesized
agugaaucgaugucucugg

SEQ ID NO: 18657 - RNA, 19 nt, artificial
  Chemically synthesized
ugcuccagcgacuacugcc

SEQ ID NO: 18658 - RNA, 19 nt, artificial
  Chemically synthesized
ugucacagcauccaugggc

SEQ ID NO: 18659 - RNA, 19 nt, artificial
  Chemically synthesized
uagugacagaggauguccc

SEQ ID NO: 18660 - RNA, 19 nt, artificial
  Chemically synthesized
uuucuagaacuagagauag

SEQ ID NO: 18661 - RNA, 19 nt, artificial
  Chemically synthesized
augaaugaaaccuugccug

SEQ ID NO: 18662 - RNA, 19 nt, artificial
  Chemically synthesized
uucuugggcuucuucagca

SEQ ID NO: 18663 - RNA, 19 nt, artificial
  Chemically synthesized
aaauggugauucuucccag

SEQ ID NO: 18664 - RNA, 19 nt, artificial
  Chemically synthesized
acuacugccacugucacuc

SEQ ID NO: 18665 - RNA, 19 nt, artificial
  Chemically synthesized
uucuccugugaaaggcugg

SEQ ID NO: 18666 - RNA, 19 nt, artificial
  Chemically synthesized
aaggugaagauggugacug

SEQ ID NO: 18667 - RNA, 19 nt, artificial
  Chemically synthesized
uucucuuucuagaacuaga

SEQ ID NO: 18668 - RNA, 19 nt, artificial
  Chemically synthesized
gauucuuguugcuuucucc

SEQ ID NO: 18669 - RNA, 19 nt, artificial
  Chemically synthesized
uuugugucuuuaauggcac

SEQ ID NO: 18670 - RNA, 19 nt, artificial
  Chemically synthesized
aagauggugacugugaaag

SEQ ID NO: 18671 - RNA, 19 nt, artificial
  Chemically synthesized
uugugaucucaggugaagg

SEQ ID NO: 18672 - RNA, 19 nt, artificial
  Chemically synthesized
ugaggaacuguucucugcu

SEQ ID NO: 18673 - RNA, 19 nt, artificial
  Chemically synthesized
ucaacaacaaacuuacuga

SEQ ID NO: 18674 - RNA, 19 nt, artificial
  Chemically synthesized
aggaacuguucucugcucc

SEQ ID NO: 18675 - RNA, 19 nt, artificial
  Chemically synthesized
ucauggagcagccaucagg

SEQ ID NO: 18676 - RNA, 19 nt, artificial
  Chemically synthesized
ucucuuugguggaucugcg

SEQ ID NO: 18677 - RNA, 19 nt, artificial
  Chemically synthesized
acgucauagucuuugcucc

SEQ ID NO: 18678 - RNA, 19 nt, artificial
  Chemically synthesized
ucuuucuagaacuagagau

SEQ ID NO: 18679 - RNA, 19 nt, artificial
  Chemically synthesized
aguucaacaacaaacuuac

SEQ ID NO: 18680 - RNA, 19 nt, artificial
  Chemically synthesized
uuugaagugaaucgauguc

SEQ ID NO: 18681 - RNA, 19 nt, artificial
  Chemically synthesized
uguaguauucuagugacac

SEQ ID NO: 18682 - RNA, 19 nt, artificial
  Chemically synthesized
ugucucugggaagaggaac

SEQ ID NO: 18683 - RNA, 19 nt, artificial
  Chemically synthesized
uuugcuccagcgacuacug

SEQ ID NO: 18684 - RNA, 19 nt, artificial
  Chemically synthesized
uuucuguggagcagagccu

SEQ ID NO: 18685 - RNA, 19 nt, artificial
  Chemically synthesized
ucugggaagaggaacagag

SEQ ID NO: 18686 - RNA, 19 nt, artificial
  Chemically synthesized
uagguuugugucuuuaaug

SEQ ID NO: 18687 - RNA, 19 nt, artificial
  Chemically synthesized
uaggcugugaagcaucgcu

SEQ ID NO: 18688 - RNA, 19 nt, artificial
  Chemically synthesized
aaaaauggugauucuuccc

SEQ ID NO: 18689 - RNA, 19 nt, artificial
  Chemically synthesized
uugggcuucuucagcaggg

SEQ ID NO: 18690 - RNA, 19 nt, artificial
  Chemically synthesized
ucuagugacacuucuccug

SEQ ID NO: 18691 - RNA, 19 nt, artificial
  Chemically synthesized
ucgacguaguacaugaauc

SEQ ID NO: 18692 - RNA, 19 nt, artificial
  Chemically synthesized
uagucuuugcuccagcgac

SEQ ID NO: 18693 - RNA, 19 nt, artificial
  Chemically synthesized
uguugcuuucuccugaugc

SEQ ID NO: 18694 - RNA, 19 nt, artificial
  Chemically synthesized
uuuuuucagcaaaagaggg

SEQ ID NO: 18695 - RNA, 19 nt, artificial
  Chemically synthesized
uucucugcuccaccuggcc

SEQ ID NO: 18696 - RNA, 19 nt, artificial
  Chemically synthesized
auaaggaauacagucaucu

SEQ ID NO: 18697 - RNA, 19 nt, artificial
  Chemically synthesized
agaugaaugaaaccuugcc

SEQ ID NO: 18698 - RNA, 19 nt, artificial
  Chemically synthesized
ugcaaucuaggcuucuugc

SEQ ID NO: 18699 - RNA, 19 nt, artificial
  Chemically synthesized
ucugccagaagaaaaaugg

SEQ ID NO: 18700 - RNA, 19 nt, artificial
  Chemically synthesized
aggcauugaacccugagcc

SEQ ID NO: 18701 - RNA, 19 nt, artificial
  Chemically synthesized
aaacuuacugagaacagau

SEQ ID NO: 18702 - RNA, 19 nt, artificial
  Chemically synthesized
ucuuugaagugaaucgaug

SEQ ID NO: 18703 - RNA, 19 nt, artificial
  Chemically synthesized
uguucucugcuccaccugg

SEQ ID NO: 18704 - RNA, 19 nt, artificial
  Chemically synthesized
uacugagaacagaugaaug

SEQ ID NO: 18705 - RNA, 19 nt, artificial
  Chemically synthesized
uucccaucucuucacuugc

SEQ ID NO: 18706 - RNA, 19 nt, artificial
  Chemically synthesized
uuacugagaacagaugaau

SEQ ID NO: 18707 - RNA, 19 nt, artificial
  Chemically synthesized
uaguauucuagugacacuu

SEQ ID NO: 18708 - RNA, 19 nt, artificial
  Chemically synthesized
uucuguuucuagcuucacu

SEQ ID NO: 18709 - RNA, 19 nt, artificial
  Chemically synthesized
aagugaaucgaugucucug

SEQ ID NO: 18710 - RNA, 19 nt, artificial
  Chemically synthesized
uacgccagugcccaguucc

SEQ ID NO: 18711 - RNA, 19 nt, artificial
  Chemically synthesized
gaaaguaucagcuuuagcc

SEQ ID NO: 18712 - RNA, 19 nt, artificial
  Chemically synthesized
agaccacugaugaagcucc

SEQ ID NO: 18713 - RNA, 19 nt, artificial
  Chemically synthesized
ugaagcucccagaugucac

SEQ ID NO: 18714 - RNA, 19 nt, artificial
  Chemically synthesized
uguccugugagguaggcug

SEQ ID NO: 18715 - RNA, 19 nt, artificial
  Chemically synthesized
uuaaguuucuguggagcag

SEQ ID NO: 18716 - RNA, 19 nt, artificial
  Chemically synthesized
auuucuggcuuccucaugg

SEQ ID NO: 18717 - RNA, 19 nt, artificial
  Chemically synthesized
uaggcuucuugcugaucag

SEQ ID NO: 18718 - RNA, 19 nt, artificial
  Chemically synthesized
uaguacaugaaucggagcu

SEQ ID NO: 18719 - RNA, 19 nt, artificial
  Chemically synthesized
uugaucaguaccacuuccu

SEQ ID NO: 18720 - RNA, 19 nt, artificial
  Chemically synthesized
uggucuucuuagggagccc

SEQ ID NO: 18721 - RNA, 19 nt, artificial
  Chemically synthesized
auggucuucuuagggagcc

SEQ ID NO: 18722 - RNA, 19 nt, artificial
  Chemically synthesized
aaucgaugucucugggaag

SEQ ID NO: 18723 - RNA, 19 nt, artificial
  Chemically synthesized
uucagaauggccucuaggc

SEQ ID NO: 18724 - RNA, 19 nt, artificial
  Chemically synthesized
uacagugcagugcugacug

SEQ ID NO: 18725 - RNA, 19 nt, artificial
  Chemically synthesized
uuucagccuuaaguuucug

SEQ ID NO: 18726 - RNA, 19 nt, artificial
  Chemically synthesized
auggccucuaggcuucuag

SEQ ID NO: 18727 - RNA, 19 nt, artificial
  Chemically synthesized
agggauaccaguguacgcc

SEQ ID NO: 18728 - RNA, 19 nt, artificial
  Chemically synthesized
agcaucugguacuugcacc

SEQ ID NO: 18729 - RNA, 19 nt, artificial
  Chemically synthesized
auaacaagugucaacugag

SEQ ID NO: 18730 - RNA, 19 nt, artificial
  Chemically synthesized
cuucacuccaauuuccggg

SEQ ID NO: 18731 - RNA, 19 nt, artificial
  Chemically synthesized
uugugggaauccgaggccc

SEQ ID NO: 18732 - RNA, 19 nt, artificial
  Chemically synthesized
ugugaucucaggugaaggc

SEQ ID NO: 18733 - RNA, 19 nt, artificial
  Chemically synthesized
uggguuuucuguuucuagc

SEQ ID NO: 18734 - RNA, 19 nt, artificial
  Chemically synthesized
uaugagcucagcaugacca

SEQ ID NO: 18735 - RNA, 19 nt, artificial
  Chemically synthesized
uucauuucaguucaacaac

SEQ ID NO: 18736 - RNA, 19 nt, artificial
  Chemically synthesized
auucuucccaguccaaagg

SEQ ID NO: 18737 - RNA, 19 nt, artificial
  Chemically synthesized
aauggaagccugaugggug

SEQ ID NO: 18738 - RNA, 19 nt, artificial
  Chemically synthesized
aggaauacagucaucugcc

SEQ ID NO: 18739 - RNA, 19 nt, artificial
  Chemically synthesized
aguaccacuuccuaccacc

SEQ ID NO: 18740 - RNA, 19 nt, artificial
  Chemically synthesized
cucuccauggucuucuuag

SEQ ID NO: 18741 - RNA, 19 nt, artificial
  Chemically synthesized
uuccucauggcuuuccuag

SEQ ID NO: 18742 - RNA, 19 nt, artificial
  Chemically synthesized
uucuugcugaucagucagg

SEQ ID NO: 18743 - RNA, 19 nt, artificial
  Chemically synthesized
ugacucacucccuauaccu

SEQ ID NO: 18744 - RNA, 19 nt, artificial
  Chemically synthesized
uaggagaccagguccuggg

SEQ ID NO: 18745 - RNA, 19 nt, artificial
  Chemically synthesized
aggacuggauucuuguugc

SEQ ID NO: 18746 - RNA, 19 nt, artificial
  Chemically synthesized
agcuucacuccaauuuccg

SEQ ID NO: 18747 - RNA, 19 nt, artificial
  Chemically synthesized
auucuuguugcuuucuccu

SEQ ID NO: 18748 - RNA, 19 nt, artificial
  Chemically synthesized
aguccaaaggugaagaugg

SEQ ID NO: 18749 - RNA, 19 nt, artificial
  Chemically synthesized
ucacauuugugggaauccg

SEQ ID NO: 18750 - RNA, 19 nt, artificial
  Chemically synthesized
aacaagugucaacugagug

SEQ ID NO: 18751 - RNA, 19 nt, artificial
  Chemically synthesized
aguaauggaagccugaugg

SEQ ID NO: 18752 - RNA, 19 nt, artificial
  Chemically synthesized
uccuauaaggaauacaguc

SEQ ID NO: 18753 - RNA, 19 nt, artificial
  Chemically synthesized
ucgaugaugccauagcgug

SEQ ID NO: 18754 - RNA, 19 nt, artificial
  Chemically synthesized
acuucuccugugaaaggcu

SEQ ID NO: 18755 - RNA, 19 nt, artificial
  Chemically synthesized
agucuugaccucauggagc

SEQ ID NO: 18756 - RNA, 19 nt, artificial
  Chemically synthesized
acugucacucgcaugugug

SEQ ID NO: 18757 - RNA, 19 nt, artificial
  Chemically synthesized
uguuucuagcuucacucca

SEQ ID NO: 18758 - RNA, 19 nt, artificial
  Chemically synthesized
uucuguggagcagagccug

SEQ ID NO: 18759 - RNA, 19 nt, artificial
  Chemically synthesized
aaggcuggcagagcaacug

SEQ ID NO: 18760 - RNA, 19 nt, artificial
  Chemically synthesized
ugaugggugcucugauccc

SEQ ID NO: 18761 - RNA, 19 nt, artificial
  Chemically synthesized
auucccaucucuucacuug

SEQ ID NO: 18762 - RNA, 19 nt, artificial
  Chemically synthesized
aaggaauacagucaucugc

SEQ ID NO: 18763 - RNA, 19 nt, artificial
  Chemically synthesized
ugucacucgcauguguggg

SEQ ID NO: 18764 - RNA, 19 nt, artificial
  Chemically synthesized
uuuaggagggauaccagug

SEQ ID NO: 18765 - RNA, 19 nt, artificial
  Chemically synthesized
acauuugugggaauccgag

SEQ ID NO: 18766 - RNA, 19 nt, artificial
  Chemically synthesized
uugcgaugagggcugcgcg

SEQ ID NO: 18767 - RNA, 19 nt, artificial
  Chemically synthesized
accaccuccaauuucuggc

SEQ ID NO: 18768 - RNA, 19 nt, artificial
  Chemically synthesized
uuuucuguuucuagcuuca

SEQ ID NO: 18769 - RNA, 19 nt, artificial
  Chemically synthesized
aaaaaauacagugcagugc

SEQ ID NO: 18770 - RNA, 19 nt, artificial
  Chemically synthesized
uaaguuucuguggagcaga

SEQ ID NO: 18771 - RNA, 19 nt, artificial
  Chemically synthesized
ugcagcaucugguacuugc

SEQ ID NO: 18772 - RNA, 19 nt, artificial
  Chemically synthesized
caucucuucacuugcuccc

SEQ ID NO: 18773 - RNA, 19 nt, artificial
  Chemically synthesized
agaugucacagcauccaug

SEQ ID NO: 18774 - RNA, 19 nt, artificial
  Chemically synthesized
caaucuaggcuucuugcug

SEQ ID NO: 18775 - RNA, 19 nt, artificial
  Chemically synthesized
ucugguacuugcaccaggg

SEQ ID NO: 18776 - RNA, 19 nt, artificial
  Chemically synthesized
ugggagacgugacugagcu

SEQ ID NO: 18777 - RNA, 19 nt, artificial
  Chemically synthesized
ucuccugugaaaggcuggc

SEQ ID NO: 18778 - RNA, 19 nt, artificial
  Chemically synthesized
gcaacuaggaagaccaucc

SEQ ID NO: 18779 - RNA, 19 nt, artificial
  Chemically synthesized
ugagucacuucuuuaggag

SEQ ID NO: 18780 - RNA, 19 nt, artificial
  Chemically synthesized
uuagccagaccacugauga

SEQ ID NO: 18781 - RNA, 19 nt, artificial
  Chemically synthesized
ugaaucggagcucaggugg

SEQ ID NO: 18782 - RNA, 19 nt, artificial
  Chemically synthesized
acuugcucccuccaccacc

SEQ ID NO: 18783 - RNA, 19 nt, artificial
  Chemically synthesized
uauguaaggccguagugac

SEQ ID NO: 18784 - RNA, 19 nt, artificial
  Chemically synthesized
aauccgaggcccugcaugg

SEQ ID NO: 18785 - RNA, 19 nt, artificial
  Chemically synthesized
aggucuuccucacuguggc

SEQ ID NO: 18786 - RNA, 19 nt, artificial
  Chemically synthesized
agaccauccauggugaggc

SEQ ID NO: 18787 - RNA, 19 nt, artificial
  Chemically synthesized
aacaaacuuacugagaaca

SEQ ID NO: 18788 - RNA, 19 nt, artificial
  Chemically synthesized
uuuagccagaccacugaug

SEQ ID NO: 18789 - RNA, 19 nt, artificial
  Chemically synthesized
uggugauucuucccagucc

SEQ ID NO: 18790 - RNA, 19 nt, artificial
  Chemically synthesized
ucgaugucucugggaagag

SEQ ID NO: 18791 - RNA, 19 nt, artificial
  Chemically synthesized
acuguucucugcuccaccu

SEQ ID NO: 18792 - RNA, 19 nt, artificial
  Chemically synthesized
uucuggcuuccucauggcc

SEQ ID NO: 18793 - RNA, 19 nt, artificial
  Chemically synthesized
ucuugggcuucuucagcag

SEQ ID NO: 18794 - RNA, 19 nt, artificial
  Chemically synthesized
uaaggaauacagucaucug

SEQ ID NO: 18795 - RNA, 19 nt, artificial
  Chemically synthesized
acugcaucuucccuacagc

SEQ ID NO: 18796 - RNA, 19 nt, artificial
  Chemically synthesized
aggagacccagucuugacc

SEQ ID NO: 18797 - RNA, 19 nt, artificial
  Chemically synthesized
guuucuguggagcagagcc

SEQ ID NO: 18798 - RNA, 19 nt, artificial
  Chemically synthesized
aggcugugaagcaucgcug

SEQ ID NO: 18799 - RNA, 19 nt, artificial
  Chemically synthesized
uugggccucuucuugggcu

SEQ ID NO: 18800 - RNA, 19 nt, artificial
  Chemically synthesized
ugccuagaggcuucuuagg

SEQ ID NO: 18801 - RNA, 19 nt, artificial
  Chemically synthesized
aaggcauugaacccugagc

SEQ ID NO: 18802 - RNA, 19 nt, artificial
  Chemically synthesized
agcugaggaacuguucucu

SEQ ID NO: 18803 - RNA, 19 nt, artificial
  Chemically synthesized
acuaggaagaccauccaug

SEQ ID NO: 18804 - RNA, 19 nt, artificial
  Chemically synthesized
augggcuugugaucucagg

SEQ ID NO: 18805 - RNA, 19 nt, artificial
  Chemically synthesized
gaaaaauggugauucuucc

SEQ ID NO: 18806 - RNA, 19 nt, artificial
  Chemically synthesized
uauaccucuugucacauuu

SEQ ID NO: 18807 - RNA, 19 nt, artificial
  Chemically synthesized
uaauggaagccugaugggu

SEQ ID NO: 18808 - RNA, 19 nt, artificial
  Chemically synthesized
uuugguggaucugcgcgcg

SEQ ID NO: 18809 - RNA, 19 nt, artificial
  Chemically synthesized
acgcaugacagcuucuuug

SEQ ID NO: 18810 - RNA, 19 nt, artificial
  Chemically synthesized
aacuuacugagaacagaug

SEQ ID NO: 18811 - RNA, 19 nt, artificial
  Chemically synthesized
auggguuuucuguuucuag

SEQ ID NO: 18812 - RNA, 19 nt, artificial
  Chemically synthesized
ugauagggagaagugagag

SEQ ID NO: 18813 - RNA, 19 nt, artificial
  Chemically synthesized
auucagaauggccucuagg

SEQ ID NO: 18814 - RNA, 19 nt, artificial
  Chemically synthesized
ugucaacugagugucugca

SEQ ID NO: 18815 - RNA, 19 nt, artificial
  Chemically synthesized
aagcgcugugacucacucc

SEQ ID NO: 18816 - RNA, 19 nt, artificial
  Chemically synthesized
aaaaauacagugcagugcu

SEQ ID NO: 18817 - RNA, 19 nt, artificial
  Chemically synthesized
agcgcugugacucacuccc

SEQ ID NO: 18818 - RNA, 19 nt, artificial
  Chemically synthesized
agcucuuugaagugaaucg

SEQ ID NO: 18819 - RNA, 19 nt, artificial
  Chemically synthesized
ugagugucugcagauaacg

SEQ ID NO: 18820 - RNA, 19 nt, artificial
  Chemically synthesized
caaaaguacacauuggagg

SEQ ID NO: 18821 - RNA, 19 nt, artificial
  Chemically synthesized
uuagaaggacuuccuaugu

SEQ ID NO: 18822 - RNA, 19 nt, artificial
  Chemically synthesized
agugucaacugagugucug

SEQ ID NO: 18823 - RNA, 19 nt, artificial
  Chemically synthesized
uaaaaaauacagugcagug

SEQ ID NO: 18824 - RNA, 19 nt, artificial
  Chemically synthesized
uagugacacuucuccugug

SEQ ID NO: 18825 - RNA, 19 nt, artificial
  Chemically synthesized
uggauucccaucucuucac

SEQ ID NO: 18826 - RNA, 19 nt, artificial
  Chemically synthesized
uauaaggaauacagucauc

SEQ ID NO: 18827 - RNA, 19 nt, artificial
  Chemically synthesized
uuucuagcuucacuccaau

SEQ ID NO: 18828 - RNA, 19 nt, artificial
  Chemically synthesized
aauuucuggcuuccucaug

SEQ ID NO: 18829 - RNA, 19 nt, artificial
  Chemically synthesized
ucggacacuauagcgccgc

SEQ ID NO: 18830 - RNA, 19 nt, artificial
  Chemically synthesized
aacagaugaaugaaaccuu

SEQ ID NO: 18831 - RNA, 19 nt, artificial
  Chemically synthesized
aaaauggugauucuuccca

SEQ ID NO: 18832 - RNA, 19 nt, artificial
  Chemically synthesized
ugagguaggcugugaagca

SEQ ID NO: 18833 - RNA, 19 nt, artificial
  Chemically synthesized
ucagccaucuugccuagag

SEQ ID NO: 18834 - RNA, 19 nt, artificial
  Chemically synthesized
acucccuauaccucuuguc

SEQ ID NO: 18835 - RNA, 19 nt, artificial
  Chemically synthesized
uugugucuuuaauggcacc

SEQ ID NO: 18836 - RNA, 19 nt, artificial
  Chemically synthesized
auacagugcagugcugacu

SEQ ID NO: 18837 - RNA, 19 nt, artificial
  Chemically synthesized
acagcucggacacuauagc

SEQ ID NO: 18838 - RNA, 19 nt, artificial
  Chemically synthesized
cugaggaacuguucucugc

SEQ ID NO: 18839 - RNA, 19 nt, artificial
  Chemically synthesized
acaaacuuacugagaacag

SEQ ID NO: 18840 - RNA, 19 nt, artificial
  Chemically synthesized
cauuugugggaauccgagg

SEQ ID NO: 18841 - RNA, 19 nt, artificial
  Chemically synthesized
ucagaauggccucuaggcu

SEQ ID NO: 18842 - RNA, 19 nt, artificial
  Chemically synthesized
uaggccgagagccaggagc

SEQ ID NO: 18843 - RNA, 19 nt, artificial
  Chemically synthesized
uucuagaacuagagauaga

SEQ ID NO: 18844 - RNA, 19 nt, artificial
  Chemically synthesized
ugagugugaaggacuggau

SEQ ID NO: 18845 - RNA, 19 nt, artificial
  Chemically synthesized
acagcuucuuugacuugac

SEQ ID NO: 18846 - RNA, 19 nt, artificial
  Chemically synthesized
ucaacugagugucugcaga

SEQ ID NO: 18847 - RNA, 19 nt, artificial
  Chemically synthesized
ugggcuugugaucucaggu

SEQ ID NO: 18848 - RNA, 19 nt, artificial
  Chemically synthesized
ucucuucacuugcucccuc

SEQ ID NO: 18849 - RNA, 19 nt, artificial
  Chemically synthesized
aaucuaggcuucuugcuga

SEQ ID NO: 18850 - RNA, 19 nt, artificial
  Chemically synthesized
agcucggacacuauagcgc

SEQ ID NO: 18851 - RNA, 19 nt, artificial
  Chemically synthesized
uggugacugugaaaguauc

SEQ ID NO: 18852 - RNA, 19 nt, artificial
  Chemically synthesized
agaagaaaaauggugauuc

SEQ ID NO: 18853 - RNA, 19 nt, artificial
  Chemically synthesized
ucugccugaaccagucagc

SEQ ID NO: 18854 - RNA, 19 nt, artificial
  Chemically synthesized
aucauugaucaguaccacu

SEQ ID NO: 18855 - RNA, 19 nt, artificial
  Chemically synthesized
aggucgaugaugccauagc

SEQ ID NO: 18856 - RNA, 19 nt, artificial
  Chemically synthesized
uagugggcuguccugugag

SEQ ID NO: 18857 - RNA, 19 nt, artificial
  Chemically synthesized
ugccacugucacucgcaug

SEQ ID NO: 18858 - RNA, 19 nt, artificial
  Chemically synthesized
gacugugaaaguaucagcu

SEQ ID NO: 18859 - RNA, 19 nt, artificial
  Chemically synthesized
aguagugugagugugaagg

SEQ ID NO: 18860 - RNA, 19 nt, artificial
  Chemically synthesized
aucuugccuagaggcuucu

SEQ ID NO: 18861 - RNA, 19 nt, artificial
  Chemically synthesized
aucucuucacuugcucccu

SEQ ID NO: 18862 - RNA, 19 nt, artificial
  Chemically synthesized
ucucugggaagaggaacag

SEQ ID NO: 18863 - RNA, 19 nt, artificial
  Chemically synthesized
cuucuugggcuucuucagc

SEQ ID NO: 18864 - RNA, 19 nt, artificial
  Chemically synthesized
agaaaaauggugauucuuc

SEQ ID NO: 18865 - RNA, 19 nt, artificial
  Chemically synthesized
aaagcgcugugacucacuc

SEQ ID NO: 18866 - RNA, 19 nt, artificial
  Chemically synthesized
aggacuuccuauguaaggc

SEQ ID NO: 18867 - RNA, 19 nt, artificial
  Chemically synthesized
augggugcucugaucccag

SEQ ID NO: 18868 - RNA, 19 nt, artificial
  Chemically synthesized
caacaacaaacuuacugag

SEQ ID NO: 18869 - RNA, 19 nt, artificial
  Chemically synthesized
ugccagaagaaaaauggug

SEQ ID NO: 18870 - RNA, 19 nt, artificial
  Chemically synthesized
ucacucgcaugugugggug

SEQ ID NO: 18871 - RNA, 19 nt, artificial
  Chemically synthesized
acacauuggaggaaauaau

SEQ ID NO: 18872 - RNA, 19 nt, artificial
  Chemically synthesized
uugcugaucagucagguga

SEQ ID NO: 18873 - RNA, 19 nt, artificial
  Chemically synthesized
ugugaagcaucgcuggagg

SEQ ID NO: 18874 - RNA, 19 nt, artificial
  Chemically synthesized
aucugguacuugcaccagg

SEQ ID NO: 18875 - RNA, 19 nt, artificial
  Chemically synthesized
auccaugggcuugugaucu

SEQ ID NO: 18876 - RNA, 19 nt, artificial
  Chemically synthesized
ugaaucgaugucucuggga

SEQ ID NO: 18877 - RNA, 19 nt, artificial
  Chemically synthesized
aguauucuagugacacuuc

SEQ ID NO: 18878 - RNA, 19 nt, artificial
  Chemically synthesized
guucucugcuccaccuggc

SEQ ID NO: 18879 - RNA, 19 nt, artificial
  Chemically synthesized
uucuuaggccgagagccag

SEQ ID NO: 18880 - RNA, 19 nt, artificial
  Chemically synthesized
auggugauucuucccaguc

SEQ ID NO: 18881 - RNA, 19 nt, artificial
  Chemically synthesized
accacuuccuaccaccucc

SEQ ID NO: 18882 - RNA, 19 nt, artificial
  Chemically synthesized
guuuucuguuucuagcuuc

SEQ ID NO: 18883 - RNA, 19 nt, artificial
  Chemically synthesized
cuagcuucacuccaauuuc

SEQ ID NO: 18884 - RNA, 19 nt, artificial
  Chemically synthesized
ugaaaguaucagcuuuagc

SEQ ID NO: 18885 - RNA, 19 nt, artificial
  Chemically synthesized
cugcaaucuaggcuucuug

SEQ ID NO: 18886 - RNA, 19 nt, artificial
  Chemically synthesized
uucuagcuucacuccaauu

SEQ ID NO: 18887 - RNA, 19 nt, artificial
  Chemically synthesized
ugcaucuucccuacagcuc

SEQ ID NO: 18888 - RNA, 19 nt, artificial
  Chemically synthesized
aacaacaaacuuacugaga

SEQ ID NO: 18889 - RNA, 19 nt, artificial
  Chemically synthesized
ucuagaacuagagauagaa

SEQ ID NO: 18890 - RNA, 19 nt, artificial
  Chemically synthesized
auggugacugugaaaguau

SEQ ID NO: 18891 - RNA, 19 nt, artificial
  Chemically synthesized
cagcugaggaacuguucuc

SEQ ID NO: 18892 - RNA, 19 nt, artificial
  Chemically synthesized
aggcuucuagguuuguguc

SEQ ID NO: 18893 - RNA, 19 nt, artificial
  Chemically synthesized
acagaugaaugaaaccuug

SEQ ID NO: 18894 - RNA, 19 nt, artificial
  Chemically synthesized
agucaggugagucacuucu

SEQ ID NO: 18895 - RNA, 19 nt, artificial
  Chemically synthesized
cuugcucccuccaccaccc

SEQ ID NO: 18896 - RNA, 19 nt, artificial
  Chemically synthesized
agagccaggagcugggagg

SEQ ID NO: 18897 - RNA, 19 nt, artificial
  Chemically synthesized
uggccucuaggcuucuagg

SEQ ID NO: 18898 - RNA, 19 nt, artificial
  Chemically synthesized
agguuugugucuuuaaugg

SEQ ID NO: 18899 - RNA, 19 nt, artificial
  Chemically synthesized
gaugaaugaaaccuugccu

SEQ ID NO: 18900 - RNA, 19 nt, artificial
  Chemically synthesized
aggcugggagacgugacug

SEQ ID NO: 18901 - RNA, 19 nt, artificial
  Chemically synthesized
ucuucagcagggucugccu

SEQ ID NO: 18902 - RNA, 19 nt, artificial
  Chemically synthesized
ucuaggcuucuugcugauc

SEQ ID NO: 18903 - RNA, 19 nt, artificial
  Chemically synthesized
agguaggcugugaagcauc

SEQ ID NO: 18904 - RNA, 19 nt, artificial
  Chemically synthesized
gugacuacugcucagugcc

SEQ ID NO: 18905 - RNA, 19 nt, artificial
  Chemically synthesized
uccucauggcuuuccuagg

SEQ ID NO: 18906 - RNA, 19 nt, artificial
  Chemically synthesized
agugacuacugcucagugc

SEQ ID NO: 18907 - RNA, 19 nt, artificial
  Chemically synthesized
ucuucccaguccaaaggug

SEQ ID NO: 18908 - RNA, 19 nt, artificial
  Chemically synthesized
ugaugaagcucccagaugu

SEQ ID NO: 18909 - RNA, 19 nt, artificial
  Chemically synthesized
ucccagaugucacagcauc

SEQ ID NO: 18910 - RNA, 19 nt, artificial
  Chemically synthesized
agagcaacuggcacagggc

SEQ ID NO: 18911 - RNA, 19 nt, artificial
  Chemically synthesized
ugugacucacucccuauac

SEQ ID NO: 18912 - RNA, 19 nt, artificial
  Chemically synthesized
aaggacuuccuauguaagg

SEQ ID NO: 18913 - RNA, 19 nt, artificial
  Chemically synthesized
gauucuucccaguccaaag

SEQ ID NO: 18914 - RNA, 19 nt, artificial
  Chemically synthesized
gugcugacugcaucuuccc

SEQ ID NO: 18915 - RNA, 19 nt, artificial
  Chemically synthesized
ccaucucuucacuugcucc

SEQ ID NO: 18916 - RNA, 19 nt, artificial
  Chemically synthesized
aguugcaggaagcagcgca

SEQ ID NO: 18917 - RNA, 19 nt, artificial
  Chemically synthesized
ugugaaaggcuggcagagc

SEQ ID NO: 18918 - RNA, 19 nt, artificial
  Chemically synthesized
aaaccuugccuguccuaua

SEQ ID NO: 18919 - RNA, 19 nt, artificial
  Chemically synthesized
uucuuagggagcccacagu

SEQ ID NO: 18920 - RNA, 19 nt, artificial
  Chemically synthesized
ugaaugaaaccuugccugu

SEQ ID NO: 18921 - RNA, 19 nt, artificial
  Chemically synthesized
guugcuuucuccugaugcc

SEQ ID NO: 18922 - RNA, 19 nt, artificial
  Chemically synthesized
agaacagaugaaugaaacc

SEQ ID NO: 18923 - RNA, 19 nt, artificial
  Chemically synthesized
cuugccuagaggcuucuua

SEQ ID NO: 18924 - RNA, 19 nt, artificial
  Chemically synthesized
ucuucuuagggagcccaca

SEQ ID NO: 18925 - RNA, 19 nt, artificial
  Chemically synthesized
ucuuugguggaucugcgcg

SEQ ID NO: 18926 - RNA, 19 nt, artificial
  Chemically synthesized
gacacuucuccugugaaag

SEQ ID NO: 18927 - RNA, 19 nt, artificial
  Chemically synthesized
aaaggcuggcagagcaacu

SEQ ID NO: 18928 - RNA, 19 nt, artificial
  Chemically synthesized
gaugucucugggaagagga

SEQ ID NO: 18929 - RNA, 19 nt, artificial
  Chemically synthesized
agcagggucugccugaacc

SEQ ID NO: 18930 - RNA, 19 nt, artificial
  Chemically synthesized
accucuugucacauuugug

SEQ ID NO: 18931 - RNA, 19 nt, artificial
  Chemically synthesized
acucuuucagccuuaaguu

SEQ ID NO: 18932 - RNA, 19 nt, artificial
  Chemically synthesized
cugaugggugcucugaucc

SEQ ID NO: 18933 - RNA, 19 nt, artificial
  Chemically synthesized
acugccacugucacucgca

SEQ ID NO: 18934 - RNA, 19 nt, artificial
  Chemically synthesized
aagugucaacugagugucu

SEQ ID NO: 18935 - RNA, 19 nt, artificial
  Chemically synthesized
ucuucccuacagcucuuug

SEQ ID NO: 18936 - RNA, 19 nt, artificial
  Chemically synthesized
ucuuuaggagggauaccag

SEQ ID NO: 18937 - RNA, 19 nt, artificial
  Chemically synthesized
uagugugagugugaaggac

SEQ ID NO: 18938 - RNA, 19 nt, artificial
  Chemically synthesized
uucuucccaguccaaaggu

SEQ ID NO: 18939 - RNA, 19 nt, artificial
  Chemically synthesized
ccuagaggcuucuuaggcc

SEQ ID NO: 18940 - RNA, 19 nt, artificial
  Chemically synthesized
ucauuucaguucaacaaca

SEQ ID NO: 18941 - RNA, 19 nt, artificial
  Chemically synthesized
uccaugggcuugugaucuc

SEQ ID NO: 18942 - RNA, 19 nt, artificial
  Chemically synthesized
ugucuuuaauggcaccuag

SEQ ID NO: 18943 - RNA, 19 nt, artificial
  Chemically synthesized
caugauagggagaagugag

SEQ ID NO: 18944 - RNA, 19 nt, artificial
  Chemically synthesized
ucuugcugaucagucaggu

SEQ ID NO: 18945 - RNA, 19 nt, artificial
  Chemically synthesized
guauucuagugacacuucu

SEQ ID NO: 18946 - RNA, 19 nt, artificial
  Chemically synthesized
agacgucauagucuuugcu

SEQ ID NO: 18947 - RNA, 19 nt, artificial
  Chemically synthesized
acguaguacaugaaucgga

SEQ ID NO: 18948 - RNA, 19 nt, artificial
  Chemically synthesized
cggaguugcaggaagcagc

SEQ ID NO: 18949 - RNA, 19 nt, artificial
  Chemically synthesized
cacuucuccugugaaaggc

SEQ ID NO: 18950 - RNA, 19 nt, artificial
  Chemically synthesized
agugugaaggacuggauuc

SEQ ID NO: 18951 - RNA, 19 nt, artificial
  Chemically synthesized
gcucuuuagaaggacuucc

SEQ ID NO: 18952 - RNA, 19 nt, artificial
  Chemically synthesized
gugagguaggcugugaagc

SEQ ID NO: 18953 - RNA, 19 nt, artificial
  Chemically synthesized
uccugaaggaagcccggcg

SEQ ID NO: 18954 - RNA, 19 nt, artificial
  Chemically synthesized
auaccucuugucacauuug

SEQ ID NO: 18955 - RNA, 19 nt, artificial
  Chemically synthesized
uuguugcuuucuccugaug

SEQ ID NO: 18956 - RNA, 19 nt, artificial
  Chemically synthesized
auauaacaagugucaacug

SEQ ID NO: 18957 - RNA, 19 nt, artificial
  Chemically synthesized
cuguuucuagcuucacucc

SEQ ID NO: 18958 - RNA, 19 nt, artificial
  Chemically synthesized
ugccuuccaaguaggagac

SEQ ID NO: 18959 - RNA, 19 nt, artificial
  Chemically synthesized
cucuucuugggcuucuuca

SEQ ID NO: 18960 - RNA, 19 nt, artificial
  Chemically synthesized
gacgugacugagcugaggc

SEQ ID NO: 18961 - RNA, 19 nt, artificial
  Chemically synthesized
guugcgaugagggcugcgc

SEQ ID NO: 18962 - RNA, 19 nt, artificial
  Chemically synthesized
ugugagugugaaggacugg

SEQ ID NO: 18963 - RNA, 19 nt, artificial
  Chemically synthesized
auugaacccugagcccugg

SEQ ID NO: 18964 - RNA, 19 nt, artificial
  Chemically synthesized
aguuucuguggagcagagc

SEQ ID NO: 18965 - RNA, 19 nt, artificial
  Chemically synthesized
aucugccagaagaaaaaug

SEQ ID NO: 18966 - RNA, 19 nt, artificial
  Chemically synthesized
cacucuuucagccuuaagu

SEQ ID NO: 18967 - RNA, 19 nt, artificial
  Chemically synthesized
aguacaugaaucggagcuc

SEQ ID NO: 18968 - RNA, 19 nt, artificial
  Chemically synthesized
aaaguaucagcuuuagcca

SEQ ID NO: 18969 - RNA, 19 nt, artificial
  Chemically synthesized
aacccugagcccuggauuc

SEQ ID NO: 18970 - RNA, 19 nt, artificial
  Chemically synthesized
ugcagugcugacugcaucu

SEQ ID NO: 18971 - RNA, 19 nt, artificial
  Chemically synthesized
aagugggugccaggcuucc

SEQ ID NO: 18972 - RNA, 19 nt, artificial
  Chemically synthesized
caggugaaggcauugaacc

SEQ ID NO: 18973 - RNA, 19 nt, artificial
  Chemically synthesized
agugcugccuuccaaguag

SEQ ID NO: 18974 - RNA, 19 nt, artificial
  Chemically synthesized
cuuugguggaucugcgcgc

SEQ ID NO: 18975 - RNA, 19 nt, artificial
  Chemically synthesized
agugugagugugaaggacu

SEQ ID NO: 18976 - RNA, 19 nt, artificial
  Chemically synthesized
aauacagugcagugcugac

SEQ ID NO: 18977 - RNA, 19 nt, artificial
  Chemically synthesized
aauggugauucuucccagu

SEQ ID NO: 18978 - RNA, 19 nt, artificial
  Chemically synthesized
aaauacagugcagugcuga

SEQ ID NO: 18979 - RNA, 19 nt, artificial
  Chemically synthesized
ucccuauaccucuugucac

SEQ ID NO: 18980 - RNA, 19 nt, artificial
  Chemically synthesized
ugcauggguuuucuguuuc

SEQ ID NO: 18981 - RNA, 19 nt, artificial
  Chemically synthesized
acacuucuccugugaaagg

SEQ ID NO: 18982 - RNA, 19 nt, artificial
  Chemically synthesized
acucacucccuauaccucu

SEQ ID NO: 18983 - RNA, 19 nt, artificial
  Chemically synthesized
cuagaggcuucuuaggccg

SEQ ID NO: 18984 - RNA, 19 nt, artificial
  Chemically synthesized
acuggauucuuguugcuuu

SEQ ID NO: 18985 - RNA, 19 nt, artificial
  Chemically synthesized
agugucugcagauaacgca

SEQ ID NO: 18986 - RNA, 19 nt, artificial
  Chemically synthesized
ucaggugaaggcauugaac

SEQ ID NO: 18987 - RNA, 19 nt, artificial
  Chemically synthesized
gaugucacagcauccaugg

SEQ ID NO: 18988 - RNA, 19 nt, artificial
  Chemically synthesized
gugaugagcagcacccggc

SEQ ID NO: 18989 - RNA, 19 nt, artificial
  Chemically synthesized
ugugucuuuaauggcaccu

SEQ ID NO: 18990 - RNA, 19 nt, artificial
  Chemically synthesized
aggugaaggcauugaaccc

SEQ ID NO: 18991 - RNA, 19 nt, artificial
  Chemically synthesized
agccaucuugccuagaggc

SEQ ID NO: 18992 - RNA, 19 nt, artificial
  Chemically synthesized
agcucccagaugucacagc

SEQ ID NO: 18993 - RNA, 19 nt, artificial
  Chemically synthesized
gacgucauagucuuugcuc

SEQ ID NO: 18994 - RNA, 19 nt, artificial
  Chemically synthesized
guagugacagaggaugucc

SEQ ID NO: 18995 - RNA, 19 nt, artificial
  Chemically synthesized
gaacuguucucugcuccac

SEQ ID NO: 18996 - RNA, 19 nt, artificial
  Chemically synthesized
uaccucuugucacauuugu

SEQ ID NO: 18997 - RNA, 19 nt, artificial
  Chemically synthesized
accaguguacgccagugcc

SEQ ID NO: 18998 - RNA, 19 nt, artificial
  Chemically synthesized
uugcaucccggaguugcag

SEQ ID NO: 18999 - RNA, 19 nt, artificial
  Chemically synthesized
uauucagaauggccucuag

SEQ ID NO: 19000 - RNA, 19 nt, artificial
  Chemically synthesized
uuagggagcccacaguaau

SEQ ID NO: 19001 - RNA, 19 nt, artificial
  Chemically synthesized
uccucauggccuucuuggg

SEQ ID NO: 19002 - RNA, 19 nt, artificial
  Chemically synthesized
ucuggcuuccucauggccu

SEQ ID NO: 19003 - RNA, 19 nt, artificial
  Chemically synthesized
cuaggcuucuagguuugug

SEQ ID NO: 19004 - RNA, 19 nt, artificial
  Chemically synthesized
uuccucacuguggcacacg

SEQ ID NO: 19005 - RNA, 19 nt, artificial
  Chemically synthesized
agccagaccacugaugaag

SEQ ID NO: 19006 - RNA, 19 nt, artificial
  Chemically synthesized
cucuucacuugcucccucc

SEQ ID NO: 19007 - RNA, 19 nt, artificial
  Chemically synthesized
cgacguaguacaugaaucg

SEQ ID NO: 19008 - RNA, 19 nt, artificial
  Chemically synthesized
uggcggacacucuuucagc

SEQ ID NO: 19009 - RNA, 19 nt, artificial
  Chemically synthesized
ucccugauggcggacacuc

SEQ ID NO: 19010 - RNA, 19 nt, Artificial Sequence
  Chemically synthesized
ucaggguaugagcucagca

SEQ ID NO: 19011 - RNA, 19 nt, artificial
  Chemically synthesized
ucgcuggagcaaagacuau

SEQ ID NO: 19012 - RNA, 19 nt, artificial
  Chemically synthesized
ggcugacugguucaggcag

SEQ ID NO: 19013 - RNA, 19 nt, artificial
  Chemically synthesized
accagaugcugcaggcccu

SEQ ID NO: 19014 - RNA, 19 nt, artificial
  Chemically synthesized
gcuccgauucauguacuac

SEQ ID NO: 19015 - RNA, 19 nt, artificial
  Chemically synthesized
gugcaaguaccagaugcug

SEQ ID NO: 19016 - RNA, 19 nt, artificial
  Chemically synthesized
uggugcaaguaccagaugc

SEQ ID NO: 19017 - RNA, 19 nt, artificial
  Chemically synthesized
cagaugcugcaggcccuga

SEQ ID NO: 19018 - RNA, 19 nt, artificial
  Chemically synthesized
cuggagcaaagacuaugac

SEQ ID NO: 19019 - RNA, 19 nt, artificial
  Chemically synthesized
cuggugcaaguaccagaug

SEQ ID NO: 19020 - RNA, 19 nt, artificial
  Chemically synthesized
caaguaccagaugcugcag

SEQ ID NO: 19021 - RNA, 19 nt, artificial
  Chemically synthesized
aguaccagaugcugcaggc

SEQ ID NO: 19022 - RNA, 19 nt, artificial
  Chemically synthesized
ugcaaguaccagaugcugc

SEQ ID NO: 19023 - RNA, 19 nt, artificial
  Chemically synthesized
gaugcugcaggcccugacc

SEQ ID NO: 19024 - RNA, 19 nt, artificial
  Chemically synthesized
agaugcugcaggcccugac

SEQ ID NO: 19025 - RNA, 19 nt, artificial
  Chemically synthesized
ccagaugcugcaggcccug

SEQ ID NO: 19026 - RNA, 19 nt, artificial
  Chemically synthesized
guaccagaugcugcaggcc

SEQ ID NO: 19027 - RNA, 19 nt, artificial
  Chemically synthesized
aaguaccagaugcugcagg

SEQ ID NO: 19028 - RNA, 19 nt, artificial
  Chemically synthesized
uaccagaugcugcaggccc

SEQ ID NO: 19029 - RNA, 19 nt, artificial
  Chemically synthesized
auagucuuugcuccagcga

SEQ ID NO: 19030 - RNA, 19 nt, artificial
  Chemically synthesized
cugccugaaccagucagcc

SEQ ID NO: 19031 - RNA, 19 nt, artificial
  Chemically synthesized
agggccugcagcaucuggu

SEQ ID NO: 19032 - RNA, 19 nt, artificial
  Chemically synthesized
guaguacaugaaucggagc

SEQ ID NO: 19033 - RNA, 19 nt, artificial
  Chemically synthesized
cagcaucugguacuugcac

SEQ ID NO: 19034 - RNA, 19 nt, artificial
  Chemically synthesized
gcaucugguacuugcacca

SEQ ID NO: 19035 - RNA, 19 nt, artificial
  Chemically synthesized
ucagggccugcagcaucug

SEQ ID NO: 19036 - RNA, 19 nt, artificial
  Chemically synthesized
gucauagucuuugcuccag

SEQ ID NO: 19037 - RNA, 19 nt, artificial
  Chemically synthesized
caucugguacuugcaccag

SEQ ID NO: 19038 - RNA, 19 nt, artificial
  Chemically synthesized
cugcagcaucugguacuug

SEQ ID NO: 19039 - RNA, 19 nt, artificial
  Chemically synthesized
gccugcagcaucugguacu

SEQ ID NO: 19040 - RNA, 19 nt, artificial
  Chemically synthesized
gcagcaucugguacuugca

SEQ ID NO: 19041 - RNA, 19 nt, artificial
  Chemically synthesized
ggucagggccugcagcauc

SEQ ID NO: 19042 - RNA, 19 nt, artificial
  Chemically synthesized
gucagggccugcagcaucu

SEQ ID NO: 19043 - RNA, 19 nt, artificial
  Chemically synthesized
cagggccugcagcaucugg

SEQ ID NO: 19044 - RNA, 19 nt, artificial
  Chemically synthesized
ggccugcagcaucugguac

SEQ ID NO: 19045 - RNA, 19 nt, artificial
  Chemically synthesized
ccugcagcaucugguacuu

SEQ ID NO: 19046 - RNA, 19 nt, Artificial Sequence
  Chemically synthesized
gggccugcagcaucuggua

SEQ ID NO: 19047 - RNA, 18 nt, artificial
  Chemically synthesized
ggagaaagcaacaagaau

SEQ ID NO: 19048 - RNA, 18 nt, artificial
  Chemically synthesized
ggcuaaagcugauacuuu

SEQ ID NO: 19049 - RNA, 18 nt, artificial
  Chemically synthesized
gguggagcagagaacagu

SEQ ID NO: 19050 - RNA, 18 nt, artificial
  Chemically synthesized
ggagaagugucacuagaa

SEQ ID NO: 19051 - RNA, 18 nt, artificial
  Chemically synthesized
cccggaaauuggagugaa

SEQ ID NO: 19052 - RNA, 18 nt, artificial
  Chemically synthesized
cuaagaagaccauggaga

SEQ ID NO: 19053 - RNA, 18 nt, artificial
  Chemically synthesized
ggcucugcuccacagaaa

SEQ ID NO: 19054 - RNA, 18 nt, artificial
  Chemically synthesized
ggauggucuuccuaguug

SEQ ID NO: 19055 - RNA, 18 nt, artificial
  Chemically synthesized
gccucggauucccacaaa

SEQ ID NO: 19056 - RNA, 18 nt, artificial
  Chemically synthesized
agaagaccauggagagcu

SEQ ID NO: 19057 - RNA, 18 nt, artificial
  Chemically synthesized
gggagcaagugaagagau

SEQ ID NO: 19058 - RNA, 18 nt, artificial
  Chemically synthesized
cagcaagaagccuagauu

SEQ ID NO: 19059 - RNA, 18 nt, artificial
  Chemically synthesized
cuuucacagucaccaucu

SEQ ID NO: 19060 - RNA, 18 nt, artificial
  Chemically synthesized
cccucucacuucucccua

SEQ ID NO: 19061 - RNA, 18 nt, artificial
  Chemically synthesized
ggaagaaucaccauuuuu

SEQ ID NO: 19062 - RNA, 18 nt, artificial
  Chemically synthesized
gcagagaacaguuccuca

SEQ ID NO: 19063 - RNA, 18 nt, artificial
  Chemically synthesized
ggaaguccuucuaaagag

SEQ ID NO: 19064 - RNA, 18 nt, artificial
  Chemically synthesized
ggaagaugcagucagcac

SEQ ID NO: 19065 - RNA, 18 nt, artificial
  Chemically synthesized
caggcaagguuucauuca

SEQ ID NO: 19066 - RNA, 18 nt, artificial
  Chemically synthesized
ccagagacaucgauucac

SEQ ID NO: 19067 - RNA, 18 nt, artificial
  Chemically synthesized
ccuccaauguguacuuuu

SEQ ID NO: 19068 - RNA, 18 nt, artificial
  Chemically synthesized
gaagcuagaaacagaaaa

SEQ ID NO: 19069 - RNA, 18 nt, artificial
  Chemically synthesized
agcugauacuuucacagu

SEQ ID NO: 19070 - RNA, 18 nt, artificial
  Chemically synthesized
ggacaggcaagguuucau

SEQ ID NO: 19071 - RNA, 18 nt, artificial
  Chemically synthesized
gacacucaguugacacuu

SEQ ID NO: 19072 - RNA, 18 nt, artificial
  Chemically synthesized
gguaggaagugguacuga

SEQ ID NO: 19073 - RNA, 18 nt, artificial
  Chemically synthesized
gaaauuggagugaagcua

SEQ ID NO: 19074 - RNA, 18 nt, artificial
  Chemically synthesized
ggcacugagcaguaguca

SEQ ID NO: 19075 - RNA, 18 nt, artificial
  Chemically synthesized
caagaagccuagauugca

SEQ ID NO: 19076 - RNA, 18 nt, artificial
  Chemically synthesized
ccucggauucccacaaau

SEQ ID NO: 19077 - RNA, 18 nt, artificial
  Chemically synthesized
gagugacaguggcaguag

SEQ ID NO: 19078 - RNA, 18 nt, artificial
  Chemically synthesized
gggaagaugcagucagca

SEQ ID NO: 19079 - RNA, 18 nt, artificial
  Chemically synthesized
gggugguggagggagcaa

SEQ ID NO: 19080 - RNA, 18 nt, artificial
  Chemically synthesized
ggagggagcaagugaaga

SEQ ID NO: 19081 - RNA, 18 nt, artificial
  Chemically synthesized
ggcaucaggagaaagcaa

SEQ ID NO: 19082 - RNA, 18 nt, artificial
  Chemically synthesized
ggagcagagaacaguucc

SEQ ID NO: 19083 - RNA, 18 nt, artificial
  Chemically synthesized
guaaguuuguuguugaac

SEQ ID NO: 19084 - RNA, 18 nt, artificial
  Chemically synthesized
aggcaagguuucauucau

SEQ ID NO: 19085 - RNA, 18 nt, artificial
  Chemically synthesized
ggagcaaagacuaugacg

SEQ ID NO: 19086 - RNA, 18 nt, artificial
  Chemically synthesized
agaagugucacuagaaua

SEQ ID NO: 19087 - RNA, 18 nt, artificial
  Chemically synthesized
uaagaagccucuaggcaa

SEQ ID NO: 19088 - RNA, 18 nt, artificial
  Chemically synthesized
cugggaagaaucaccauu

SEQ ID NO: 19089 - RNA, 18 nt, artificial
  Chemically synthesized
gcuucacagccuaccuca

SEQ ID NO: 19090 - RNA, 18 nt, artificial
  Chemically synthesized
cagucaccaucuucaccu

SEQ ID NO: 19091 - RNA, 18 nt, artificial
  Chemically synthesized
agaugacuguauuccuua

SEQ ID NO: 19092 - RNA, 18 nt, artificial
  Chemically synthesized
cuuuggacugggaagaau

SEQ ID NO: 19093 - RNA, 18 nt, artificial
  Chemically synthesized
ggaucagagcacccauca

SEQ ID NO: 19094 - RNA, 18 nt, artificial
  Chemically synthesized
gcaaagacuaugacgucu

SEQ ID NO: 19095 - RNA, 18 nt, artificial
  Chemically synthesized
gcgcagcccucaucgcaa

SEQ ID NO: 19096 - RNA, 18 nt, artificial
  Chemically synthesized
guuucauucaucuguucu

SEQ ID NO: 19097 - RNA, 18 nt, artificial
  Chemically synthesized
caacaagaauccaguccu

SEQ ID NO: 19098 - RNA, 18 nt, artificial
  Chemically synthesized
gagaacaguuccucagcu

SEQ ID NO: 19099 - RNA, 18 nt, artificial
  Chemically synthesized
cuuucacaggagaagugu

SEQ ID NO: 19100 - RNA, 18 nt, artificial
  Chemically synthesized
uccucuucccagagacau

SEQ ID NO: 19101 - RNA, 18 nt, artificial
  Chemically synthesized
ggagcaagugaagagaug

SEQ ID NO: 19102 - RNA, 18 nt, artificial
  Chemically synthesized
cccacaaaugugacaaga

SEQ ID NO: 19103 - RNA, 18 nt, artificial
  Chemically synthesized
ggagugaagcuagaaaca

SEQ ID NO: 19104 - RNA, 18 nt, artificial
  Chemically synthesized
ugaagaagcccaagaaga

SEQ ID NO: 19105 - RNA, 18 nt, artificial
  Chemically synthesized
gccagguggagcagagaa

SEQ ID NO: 19106 - RNA, 18 nt, artificial
  Chemically synthesized
ggcaagguuucauucauc

SEQ ID NO: 19107 - RNA, 18 nt, artificial
  Chemically synthesized
gccgggugcugcucauca

SEQ ID NO: 19108 - RNA, 18 nt, artificial
  Chemically synthesized
gcugaagaagcccaagaa

SEQ ID NO: 19109 - RNA, 18 nt, artificial
  Chemically synthesized
ggacauccucugucacua

SEQ ID NO: 19110 - RNA, 18 nt, artificial
  Chemically synthesized
ggcucaggguucaaugcc

SEQ ID NO: 19111 - RNA, 18 nt, artificial
  Chemically synthesized
gcgcgcagauccaccaaa

SEQ ID NO: 19112 - RNA, 18 nt, artificial
  Chemically synthesized
ggcgcuauaguguccgag

SEQ ID NO: 19113 - RNA, 18 nt, artificial
  Chemically synthesized
gcaagguuucauucaucu

SEQ ID NO: 19114 - RNA, 18 nt, artificial
  Chemically synthesized
ggccuaagaagccucuag

SEQ ID NO: 19115 - RNA, 18 nt, artificial
  Chemically synthesized
cggccuaagaagccucua

SEQ ID NO: 19116 - RNA, 18 nt, artificial
  Chemically synthesized
gccucagcucagucacgu

SEQ ID NO: 19117 - RNA, 18 nt, artificial
  Chemically synthesized
cccagagacaucgauuca

SEQ ID NO: 19118 - RNA, 18 nt, artificial
  Chemically synthesized
cacaaaccuagaagccua

SEQ ID NO: 19119 - RNA, 18 nt, artificial
  Chemically synthesized
ggagcuucaucagugguc

SEQ ID NO: 19120 - RNA, 18 nt, artificial
  Chemically synthesized
gggaagaaucaccauuuu

SEQ ID NO: 19121 - RNA, 18 nt, artificial
  Chemically synthesized
ccaugaggaagccagaaa

SEQ ID NO: 19122 - RNA, 18 nt, artificial
  Chemically synthesized
cucacuucucccuaucau

SEQ ID NO: 19123 - RNA, 18 nt, artificial
  Chemically synthesized
cccuaagaagaccaugga

SEQ ID NO: 19124 - RNA, 18 nt, artificial
  Chemically synthesized
ccauggaugcugugacau

SEQ ID NO: 19125 - RNA, 18 nt, artificial
  Chemically synthesized
ccacaaaugugacaagag

SEQ ID NO: 19126 - RNA, 18 nt, artificial
  Chemically synthesized
gccuuucacaggagaagu

SEQ ID NO: 19127 - RNA, 18 nt, artificial
  Chemically synthesized
aggaaguccuucuaaaga

SEQ ID NO: 19128 - RNA, 18 nt, artificial
  Chemically synthesized
gagcaaagacuaugacgu

SEQ ID NO: 19129 - RNA, 18 nt, artificial
  Chemically synthesized
aguagucgcuggagcaaa

SEQ ID NO: 19130 - RNA, 18 nt, artificial
  Chemically synthesized
ggcucccuaagaagacca

SEQ ID NO: 19131 - RNA, 18 nt, artificial
  Chemically synthesized
agagacaucgauucacuu

SEQ ID NO: 19132 - RNA, 18 nt, artificial
  Chemically synthesized
agucaaagaagcugucau

SEQ ID NO: 19133 - RNA, 18 nt, artificial
  Chemically synthesized
acuuaaggcugaaagagu

SEQ ID NO: 19134 - RNA, 18 nt, artificial
  Chemically synthesized
ggcucucggccuaagaag

SEQ ID NO: 19135 - RNA, 18 nt, artificial
  Chemically synthesized
ugaucagcaagaagccua

SEQ ID NO: 19136 - RNA, 18 nt, artificial
  Chemically synthesized
gguucaaugccuucaccu

SEQ ID NO: 19137 - RNA, 18 nt, artificial
  Chemically synthesized
cuagaagccuagaggcca

SEQ ID NO: 19138 - RNA, 18 nt, artificial
  Chemically synthesized
uguuccucuucccagaga

SEQ ID NO: 19139 - RNA, 18 nt, artificial
  Chemically synthesized
ggcacccacuucugucuu

SEQ ID NO: 19140 - RNA, 18 nt, artificial
  Chemically synthesized
cucaguugacacuuguua

SEQ ID NO: 19141 - RNA, 18 nt, artificial
  Chemically synthesized
gagcuucaucaguggucu

SEQ ID NO: 19142 - RNA, 18 nt, artificial
  Chemically synthesized
gcaccuccagcgaugcuu

SEQ ID NO: 19143 - RNA, 18 nt, artificial
  Chemically synthesized
cagagacaucgauucacu

SEQ ID NO: 19144 - RNA, 18 nt, artificial
  Chemically synthesized
gcagacacucaguugaca

SEQ ID NO: 19145 - RNA, 18 nt, artificial
  Chemically synthesized
ccaccaaagagaaagcag

SEQ ID NO: 19146 - RNA, 18 nt, artificial
  Chemically synthesized
cugauacuuucacaguca

SEQ ID NO: 19147 - RNA, 18 nt, artificial
  Chemically synthesized
ggaagugguacugaucaa

SEQ ID NO: 19148 - RNA, 18 nt, artificial
  Chemically synthesized
ggucaugcugagcucaua

SEQ ID NO: 19149 - RNA, 18 nt, artificial
  Chemically synthesized
cugcagacacucaguuga

SEQ ID NO: 19150 - RNA, 18 nt, artificial
  Chemically synthesized
ggcguacacugguauccc

SEQ ID NO: 19151 - RNA, 18 nt, artificial
  Chemically synthesized
aggagaaagcaacaagaa

SEQ ID NO: 19152 - RNA, 18 nt, artificial
  Chemically synthesized
ggugcaaguaccagaugc

SEQ ID NO: 19153 - RNA, 18 nt, artificial
  Chemically synthesized
cagagaacaguuccucag

SEQ ID NO: 19154 - RNA, 18 nt, artificial
  Chemically synthesized
agcccauggaugcuguga

SEQ ID NO: 19155 - RNA, 18 nt, artificial
  Chemically synthesized
cgaauauccuccuggcca

SEQ ID NO: 19156 - RNA, 18 nt, artificial
  Chemically synthesized
cuccaugaggucaagacu

SEQ ID NO: 19157 - RNA, 18 nt, artificial
  Chemically synthesized
caagaauccaguccuuca

SEQ ID NO: 19158 - RNA, 18 nt, artificial
  Chemically synthesized
cccugugccaguugcucu

SEQ ID NO: 19159 - RNA, 18 nt, artificial
  Chemically synthesized
cccugauggcugcuccau

SEQ ID NO: 19160 - RNA, 18 nt, artificial
  Chemically synthesized
cucagcucagucacgucu

SEQ ID NO: 19161 - RNA, 18 nt, artificial
  Chemically synthesized
ggcagaugacuguauucc

SEQ ID NO: 19162 - RNA, 18 nt, artificial
  Chemically synthesized
ggugguaggaagugguac

SEQ ID NO: 19163 - RNA, 18 nt, artificial
  Chemically synthesized
ugggaagaaucaccauuu

SEQ ID NO: 19164 - RNA, 18 nt, artificial
  Chemically synthesized
gucaccaucuucaccuuu

SEQ ID NO: 19165 - RNA, 18 nt, artificial
  Chemically synthesized
gcugcuuccugcaacucc

SEQ ID NO: 19166 - RNA, 18 nt, artificial
  Chemically synthesized
gcaacaagaauccagucc

SEQ ID NO: 19167 - RNA, 18 nt, artificial
  Chemically synthesized
cggaaauuggagugaagc

SEQ ID NO: 19168 - RNA, 18 nt, artificial
  Chemically synthesized
ccaucuucaccuuuggac

SEQ ID NO: 19169 - RNA, 18 nt, artificial
  Chemically synthesized
gaagccucuaggcaagau

SEQ ID NO: 19170 - RNA, 18 nt, artificial
  Chemically synthesized
gcugcuccaugaggucaa

SEQ ID NO: 19171 - RNA, 18 nt, artificial
  Chemically synthesized
cgagugacaguggcagua

SEQ ID NO: 19172 - RNA, 18 nt, artificial
  Chemically synthesized
gguauagggagugaguca

SEQ ID NO: 19173 - RNA, 18 nt, artificial
  Chemically synthesized
ccaucaggcuuccauuac

SEQ ID NO: 19174 - RNA, 18 nt, artificial
  Chemically synthesized
cuucccagagacaucgau

SEQ ID NO: 19175 - RNA, 18 nt, artificial
  Chemically synthesized
cucccuaagaagaccaug

SEQ ID NO: 19176 - RNA, 18 nt, artificial
  Chemically synthesized
gacaggcaagguuucauu

SEQ ID NO: 19177 - RNA, 18 nt, artificial
  Chemically synthesized
cccacgcuauggcaucau

SEQ ID NO: 19178 - RNA, 18 nt, artificial
  Chemically synthesized
gcgaugcuucacagccua

SEQ ID NO: 19179 - RNA, 18 nt, artificial
  Chemically synthesized
gcuccaugaggucaagac

SEQ ID NO: 19180 - RNA, 18 nt, artificial
  Chemically synthesized
cucaguaaguuuguuguu

SEQ ID NO: 19181 - RNA, 18 nt, artificial
  Chemically synthesized
gaagaagcccaagaagag

SEQ ID NO: 19182 - RNA, 18 nt, artificial
  Chemically synthesized
gggugcugcucaucacgc

SEQ ID NO: 19183 - RNA, 18 nt, artificial
  Chemically synthesized
gccuaagaagccucuagg

SEQ ID NO: 19184 - RNA, 18 nt, artificial
  Chemically synthesized
cauuauuuccuccaaugu

SEQ ID NO: 19185 - RNA, 18 nt, artificial
  Chemically synthesized
ggaccuggucuccuacuu

SEQ ID NO: 19186 - RNA, 18 nt, artificial
  Chemically synthesized
ccugcugaagaagcccaa

SEQ ID NO: 19187 - RNA, 18 nt, artificial
  Chemically synthesized
agccuuucacaggagaag

SEQ ID NO: 19188 - RNA, 18 nt, artificial
  Chemically synthesized
gccauuaaagacacaaac

SEQ ID NO: 19189 - RNA, 18 nt, artificial
  Chemically synthesized
ccggaaauuggagugaag

SEQ ID NO: 19190 - RNA, 18 nt, artificial
  Chemically synthesized
gugguacugaucaaugau

SEQ ID NO: 19191 - RNA, 18 nt, artificial
  Chemically synthesized
agauccaccaaagagaaa

SEQ ID NO: 19192 - RNA, 18 nt, artificial
  Chemically synthesized
cagccuuucacaggagaa

SEQ ID NO: 19193 - RNA, 18 nt, artificial
  Chemically synthesized
agggagcaagugaagaga

SEQ ID NO: 19194 - RNA, 18 nt, artificial
  Chemically synthesized
cgauucauguacuacguc

SEQ ID NO: 19195 - RNA, 18 nt, artificial
  Chemically synthesized
cauggaugcugugacauc

SEQ ID NO: 19196 - RNA, 18 nt, artificial
  Chemically synthesized
cacccaucaggcuuccau

SEQ ID NO: 19197 - RNA, 18 nt, artificial
  Chemically synthesized
cucggauucccacaaaug

SEQ ID NO: 19198 - RNA, 18 nt, artificial
  Chemically synthesized
gcaucaucgaccucccuc

SEQ ID NO: 19199 - RNA, 18 nt, artificial
  Chemically synthesized
ccucucacuucucccuau

SEQ ID NO: 19200 - RNA, 18 nt, artificial
  Chemically synthesized
gccagaaauuggaggugg

SEQ ID NO: 19201 - RNA, 18 nt, artificial
  Chemically synthesized
ccuggugcaaguaccaga

SEQ ID NO: 19202 - RNA, 18 nt, artificial
  Chemically synthesized
cacucaguugacacuugu

SEQ ID NO: 19203 - RNA, 18 nt, artificial
  Chemically synthesized
gagaaagcaacaagaauc

SEQ ID NO: 19204 - RNA, 18 nt, artificial
  Chemically synthesized
ggccuuacauaggaaguc

SEQ ID NO: 19205 - RNA, 18 nt, artificial
  Chemically synthesized
caccugagcuccgauuca

SEQ ID NO: 19206 - RNA, 18 nt, artificial
  Chemically synthesized
cagguggagcagagaaca

SEQ ID NO: 19207 - RNA, 18 nt, artificial
  Chemically synthesized
ccugagaucacaagccca

SEQ ID NO: 19208 - RNA, 18 nt, artificial
  Chemically synthesized
gccacagugaggaagacc

SEQ ID NO: 19209 - RNA, 18 nt, artificial
  Chemically synthesized
agcaagaagccuagauug

SEQ ID NO: 19210 - RNA, 18 nt, artificial
  Chemically synthesized
ccuuuggacugggaagaa

SEQ ID NO: 19211 - RNA, 18 nt, artificial
  Chemically synthesized
guagggaagaugcaguca

SEQ ID NO: 19212 - RNA, 18 nt, artificial
  Chemically synthesized
gaugcagucagcacugca

SEQ ID NO: 19213 - RNA, 18 nt, artificial
  Chemically synthesized
acaggagaagugucacua

SEQ ID NO: 19214 - RNA, 18 nt, artificial
  Chemically synthesized
gccucaccauggaugguc

SEQ ID NO: 19215 - RNA, 18 nt, artificial
  Chemically synthesized
ucuccuacuuggaaggca

SEQ ID NO: 19216 - RNA, 18 nt, artificial
  Chemically synthesized
ggugguggagggagcaag

SEQ ID NO: 19217 - RNA, 18 nt, artificial
  Chemically synthesized
cuagaaacagaaaaccca

SEQ ID NO: 19218 - RNA, 18 nt, artificial
  Chemically synthesized
acaucgauucacuucaaa

SEQ ID NO: 19219 - RNA, 18 nt, artificial
  Chemically synthesized
caguugcucugccagccu

SEQ ID NO: 19220 - RNA, 18 nt, artificial
  Chemically synthesized
cgcuggagcaaagacuau

SEQ ID NO: 19221 - RNA, 18 nt, artificial
  Chemically synthesized
gacucaccugacugauca

SEQ ID NO: 19222 - RNA, 18 nt, artificial
  Chemically synthesized
cuccgauucauguacuac

SEQ ID NO: 19223 - RNA, 18 nt, artificial
  Chemically synthesized
ccacagaaacuuaaggcu

SEQ ID NO: 19224 - RNA, 18 nt, artificial
  Chemically synthesized
ggucaagacugggucucc

SEQ ID NO: 19225 - RNA, 18 nt, artificial
  Chemically synthesized
auaggaaguccuucuaaa

SEQ ID NO: 19226 - RNA, 18 nt, artificial
  Chemically synthesized
gaucacaagcccauggau

SEQ ID NO: 19227 - RNA, 18 nt, artificial
  Chemically synthesized
gcucccuaagaagaccau

SEQ ID NO: 19228 - RNA, 18 nt, artificial
  Chemically synthesized
gcagaugacuguauuccu

SEQ ID NO: 19229 - RNA, 18 nt, artificial
  Chemically synthesized
gaagaccauggagagcuu

SEQ ID NO: 19230 - RNA, 18 nt, artificial
  Chemically synthesized
cagcgaugcuucacagcc

SEQ ID NO: 19231 - RNA, 18 nt, artificial
  Chemically synthesized
ucuguucucaguaaguuu

SEQ ID NO: 19232 - RNA, 18 nt, artificial
  Chemically synthesized
agaaacuuaaggcugaaa

SEQ ID NO: 19233 - RNA, 18 nt, artificial
  Chemically synthesized
gcacugcacuguauuuuu

SEQ ID NO: 19234 - RNA, 18 nt, artificial
  Chemically synthesized
ccucuucccagagacauc

SEQ ID NO: 19235 - RNA, 18 nt, artificial
  Chemically synthesized
agagaacaguuccucagc

SEQ ID NO: 19236 - RNA, 18 nt, artificial
  Chemically synthesized
gaagaugcagucagcacu

SEQ ID NO: 19237 - RNA, 18 nt, artificial
  Chemically synthesized
gagcagagaacaguuccu

SEQ ID NO: 19238 - RNA, 18 nt, artificial
  Chemically synthesized
ccacagugaggaagaccu

SEQ ID NO: 19239 - RNA, 18 nt, artificial
  Chemically synthesized
gacugaucagcaagaagc

SEQ ID NO: 19240 - RNA, 18 nt, artificial
  Chemically synthesized
ggcugacugguucaggca

SEQ ID NO: 19241 - RNA, 18 nt, artificial
  Chemically synthesized
cuggcagaugacuguauu

SEQ ID NO: 19242 - RNA, 18 nt, artificial
  Chemically synthesized
cagggcucaggguucaau

SEQ ID NO: 19243 - RNA, 18 nt, artificial
  Chemically synthesized
gggcccugaugguggcuu

SEQ ID NO: 19244 - RNA, 18 nt, artificial
  Chemically synthesized
gauccaccaaagagaaag

SEQ ID NO: 19245 - RNA, 18 nt, artificial
  Chemically synthesized
guaggaagugguacugau

SEQ ID NO: 19246 - RNA, 18 nt, artificial
  Chemically synthesized
caagccucagcucaguca

SEQ ID NO: 19247 - RNA, 18 nt, artificial
  Chemically synthesized
cauggauggucuuccuag

SEQ ID NO: 19248 - RNA, 18 nt, artificial
  Chemically synthesized
caagugaagagaugggaa

SEQ ID NO: 19249 - RNA, 18 nt, artificial
  Chemically synthesized
agugucacuagaauacua

SEQ ID NO: 19250 - RNA, 18 nt, artificial
  Chemically synthesized
ccaagaagaggcccaacu

SEQ ID NO: 19251 - RNA, 18 nt, artificial
  Chemically synthesized
gguacugaucaaugaugg

SEQ ID NO: 19252 - RNA, 18 nt, artificial
  Chemically synthesized
ucggauucccacaaaugu

SEQ ID NO: 19253 - RNA, 18 nt, artificial
  Chemically synthesized
gggagugagucacagcgc

SEQ ID NO: 19254 - RNA, 18 nt, artificial
  Chemically synthesized
agucagcacugcacugua

SEQ ID NO: 19255 - RNA, 18 nt, artificial
  Chemically synthesized
caaagaagcugucaugcg

SEQ ID NO: 19256 - RNA, 18 nt, artificial
  Chemically synthesized
cgauucacuucaaagagc

SEQ ID NO: 19257 - RNA, 18 nt, artificial
  Chemically synthesized
gccaggcacugagcagua

SEQ ID NO: 19258 - RNA, 18 nt, artificial
  Chemically synthesized
guggagcagagaacaguu

SEQ ID NO: 19259 - RNA, 18 nt, artificial
  Chemically synthesized
gacccugggaucagagca

SEQ ID NO: 19260 - RNA, 18 nt, artificial
  Chemically synthesized
gucaagacugggucuccu

SEQ ID NO: 19261 - RNA, 18 nt, artificial
  Chemically synthesized
agaauccaguccuucaca

SEQ ID NO: 19262 - RNA, 18 nt, artificial
  Chemically synthesized
cugagaucacaagcccau

SEQ ID NO: 19263 - RNA, 18 nt, artificial
  Chemically synthesized
gcgcagauccaccaaaga

SEQ ID NO: 19264 - RNA, 18 nt, artificial
  Chemically synthesized
cagacacucaguugacac

SEQ ID NO: 19265 - RNA, 18 nt, artificial
  Chemically synthesized
gggagcuucaucaguggu

SEQ ID NO: 19266 - RNA, 18 nt, artificial
  Chemically synthesized
ccaugcagggccucggau

SEQ ID NO: 19267 - RNA, 18 nt, artificial
  Chemically synthesized
ccauggauggucuuccua

SEQ ID NO: 19268 - RNA, 18 nt, artificial
  Chemically synthesized
gaaagcaccuccagcgau

SEQ ID NO: 19269 - RNA, 18 nt, artificial
  Chemically synthesized
ccaucagggacauccucu

SEQ ID NO: 19270 - RNA, 18 nt, artificial
  Chemically synthesized
agccuggcacccacuucu

SEQ ID NO: 19271 - RNA, 18 nt, artificial
  Chemically synthesized
uguucucaguaaguuugu

SEQ ID NO: 19272 - RNA, 18 nt, artificial
  Chemically synthesized
uucccagagacaucgauu

SEQ ID NO: 19273 - RNA, 18 nt, artificial
  Chemically synthesized
aucuguucucaguaaguu

SEQ ID NO: 19274 - RNA, 18 nt, artificial
  Chemically synthesized
cugggagcuucaucagug

SEQ ID NO: 19275 - RNA, 18 nt, artificial
  Chemically synthesized
cucccagccugccaccca

SEQ ID NO: 19276 - RNA, 18 nt, artificial
  Chemically synthesized
agugguacugaucaauga

SEQ ID NO: 19277 - RNA, 18 nt, artificial
  Chemically synthesized
ccucuaggcaagauggcu

SEQ ID NO: 19278 - RNA, 18 nt, artificial
  Chemically synthesized
agaagccucuaggcaaga

SEQ ID NO: 19279 - RNA, 18 nt, artificial
  Chemically synthesized
ggauucccacaaauguga

SEQ ID NO: 19280 - RNA, 18 nt, artificial
  Chemically synthesized
uguacuacgucgauggca

SEQ ID NO: 19281 - RNA, 18 nt, artificial
  Chemically synthesized
ugccauuaaagacacaaa

SEQ ID NO: 19282 - RNA, 18 nt, artificial
  Chemically synthesized
gcucaggguucaaugccu

SEQ ID NO: 19283 - RNA, 18 nt, artificial
  Chemically synthesized
gacugggucuccucccuc

SEQ ID NO: 19284 - RNA, 18 nt, artificial
  Chemically synthesized
uggucuuccuaguugccu

SEQ ID NO: 19285 - RNA, 18 nt, artificial
  Chemically synthesized
cacucacacuacucuguu

SEQ ID NO: 19286 - RNA, 18 nt, artificial
  Chemically synthesized
cugggaucagagcaccca

SEQ ID NO: 19287 - RNA, 18 nt, artificial
  Chemically synthesized
gcucagucacgucuccca

SEQ ID NO: 19288 - RNA, 18 nt, artificial
  Chemically synthesized
ggacaggaagccuggcac

SEQ ID NO: 19289 - RNA, 18 nt, artificial
  Chemically synthesized
gacaagagguauagggag

SEQ ID NO: 19290 - RNA, 18 nt, artificial
  Chemically synthesized
caucaggcuuccauuacu

SEQ ID NO: 19291 - RNA, 18 nt, artificial
  Chemically synthesized
cugugggcucccuaagaa

SEQ ID NO: 19292 - RNA, 18 nt, artificial
  Chemically synthesized
cacaggcucugcuccaca

SEQ ID NO: 19293 - RNA, 18 nt, artificial
  Chemically synthesized
caugcagggccucggauu

SEQ ID NO: 19294 - RNA, 18 nt, artificial
  Chemically synthesized
cauuuuucuucuggcaga

SEQ ID NO: 19295 - RNA, 18 nt, artificial
  Chemically synthesized
aagacacaaaccuagaag

SEQ ID NO: 19296 - RNA, 18 nt, artificial
  Chemically synthesized
gcaagauggcugacuggu

SEQ ID NO: 19297 - RNA, 18 nt, artificial
  Chemically synthesized
gcuauaguguccgagcug

SEQ ID NO: 19298 - RNA, 18 nt, artificial
  Chemically synthesized
agaucacaagcccaugga

SEQ ID NO: 19299 - RNA, 18 nt, artificial
  Chemically synthesized
gcgcuauaguguccgagc

SEQ ID NO: 19300 - RNA, 18 nt, artificial
  Chemically synthesized
caucuguucucaguaagu

SEQ ID NO: 19301 - RNA, 18 nt, artificial
  Chemically synthesized
accugagcuccgauucau

SEQ ID NO: 19302 - RNA, 18 nt, artificial
  Chemically synthesized
caccugacugaucagcaa

SEQ ID NO: 19303 - RNA, 18 nt, artificial
  Chemically synthesized
agucacgucucccagccu

SEQ ID NO: 19304 - RNA, 18 nt, artificial
  Chemically synthesized
gauucacuucaaagagcu

SEQ ID NO: 19305 - RNA, 18 nt, artificial
  Chemically synthesized
gugacucaccugacugau

SEQ ID NO: 19306 - RNA, 18 nt, artificial
  Chemically synthesized
cuguucucaguaaguuug

SEQ ID NO: 19307 - RNA, 18 nt, artificial
  Chemically synthesized
caaagagaaagcagcccu

SEQ ID NO: 19308 - RNA, 18 nt, artificial
  Chemically synthesized
gaaucaccauuuuucuuc

SEQ ID NO: 19309 - RNA, 18 nt, artificial
  Chemically synthesized
cgaccucccucccagcuc

SEQ ID NO: 19310 - RNA, 18 nt, artificial
  Chemically synthesized
ggccauucugaauauggg

SEQ ID NO: 19311 - RNA, 18 nt, artificial
  Chemically synthesized
gucaagucaaagaagcug

SEQ ID NO: 19312 - RNA, 18 nt, artificial
  Chemically synthesized
agaaauuggaggugguag

SEQ ID NO: 19313 - RNA, 18 nt, artificial
  Chemically synthesized
uuggagugaagcuagaaa

SEQ ID NO: 19314 - RNA, 18 nt, artificial
  Chemically synthesized
ggagugagucacagcgcu

SEQ ID NO: 19315 - RNA, 18 nt, artificial
  Chemically synthesized
agcacugcacuguauuuu

SEQ ID NO: 19316 - RNA, 18 nt, artificial
  Chemically synthesized
cuggucuccuacuuggaa

SEQ ID NO: 19317 - RNA, 18 nt, artificial
  Chemically synthesized
agagcacccaucaggcuu

SEQ ID NO: 19318 - RNA, 18 nt, artificial
  Chemically synthesized
cuucaccugagaucacaa

SEQ ID NO: 19319 - RNA, 18 nt, artificial
  Chemically synthesized
gcuauggcaucaucgacc

SEQ ID NO: 19320 - RNA, 18 nt, artificial
  Chemically synthesized
gacugggaagaaucacca

SEQ ID NO: 19321 - RNA, 18 nt, artificial
  Chemically synthesized
ccuucacacucacacuac

SEQ ID NO: 19322 - RNA, 18 nt, artificial
  Chemically synthesized
uguauuccuuauaggaca

SEQ ID NO: 19323 - RNA, 18 nt, artificial
  Chemically synthesized
ggccgagggcugcaccau

SEQ ID NO: 19324 - RNA, 18 nt, artificial
  Chemically synthesized
gccgagggcugcaccauc

SEQ ID NO: 19325 - RNA, 18 nt, artificial
  Chemically synthesized
gccuaacuggacaggaag

SEQ ID NO: 19326 - RNA, 18 nt, artificial
  Chemically synthesized
auaggacaggcaagguuu

SEQ ID NO: 19327 - RNA, 18 nt, artificial
  Chemically synthesized
ggaugcugugacaucugg

SEQ ID NO: 19328 - RNA, 18 nt, artificial
  Chemically synthesized
caggaagccuggcaccca

SEQ ID NO: 19329 - RNA, 18 nt, artificial
  Chemically synthesized
gaagaaucaccauuuuuc

SEQ ID NO: 19330 - RNA, 18 nt, artificial
  Chemically synthesized
caucuucaccuuuggacu

SEQ ID NO: 19331 - RNA, 18 nt, artificial
  Chemically synthesized
acacuacucuguuccucu

SEQ ID NO: 19332 - RNA, 18 nt, artificial
  Chemically synthesized
gccuuacauaggaagucc

SEQ ID NO: 19333 - RNA, 18 nt, artificial
  Chemically synthesized
cccugaugguggcuuucg

SEQ ID NO: 19334 - RNA, 18 nt, artificial
  Chemically synthesized
gguaucccuccuaaagaa

SEQ ID NO: 19335 - RNA, 18 nt, artificial
  Chemically synthesized
auacuuucacagucacca

SEQ ID NO: 19336 - RNA, 18 nt, artificial
  Chemically synthesized
agguuucauucaucuguu

SEQ ID NO: 19337 - RNA, 18 nt, artificial
  Chemically synthesized
cugcgcugcuuccugcaa

SEQ ID NO: 19338 - RNA, 18 nt, artificial
  Chemically synthesized
caaaccuagaagccuaga

SEQ ID NO: 19339 - RNA, 18 nt, artificial
  Chemically synthesized
caggguucaaugccuuca

SEQ ID NO: 19340 - RNA, 18 nt, artificial
  Chemically synthesized
agagcuguagggaagaug

SEQ ID NO: 19341 - RNA, 18 nt, artificial
  Chemically synthesized
agagguauagggagugag

SEQ ID NO: 19342 - RNA, 18 nt, artificial
  Chemically synthesized
gcuccgauucauguacua

SEQ ID NO: 19343 - RNA, 18 nt, artificial
  Chemically synthesized
cuguagggaagaugcagu

SEQ ID NO: 19344 - RNA, 18 nt, artificial
  Chemically synthesized
ccuacuuggaaggcagca

SEQ ID NO: 19345 - RNA, 18 nt, artificial
  Chemically synthesized
cgcuauggcaucaucgac

SEQ ID NO: 19346 - RNA, 18 nt, artificial
  Chemically synthesized
caugaggaagccagaaau

SEQ ID NO: 19347 - RNA, 18 nt, artificial
  Chemically synthesized
agccuaccucacaggaca

SEQ ID NO: 19348 - RNA, 18 nt, artificial
  Chemically synthesized
cuauaguguccgagcugu

SEQ ID NO: 19349 - RNA, 18 nt, artificial
  Chemically synthesized
caggcacugagcaguagu

SEQ ID NO: 19350 - RNA, 18 nt, artificial
  Chemically synthesized
aagguuucauucaucugu

SEQ ID NO: 19351 - RNA, 18 nt, artificial
  Chemically synthesized
ccuagaggccauucugaa

SEQ ID NO: 19352 - RNA, 18 nt, artificial
  Chemically synthesized
gaagugguacugaucaau

SEQ ID NO: 19353 - RNA, 18 nt, artificial
  Chemically synthesized
cacacaugcgagugacag

SEQ ID NO: 19354 - RNA, 18 nt, artificial
  Chemically synthesized
uagggaagaugcagucag

SEQ ID NO: 19355 - RNA, 18 nt, artificial
  Chemically synthesized
ggaagccagaaauuggag

SEQ ID NO: 19356 - RNA, 18 nt, artificial
  Chemically synthesized
cucagucacgucucccag

SEQ ID NO: 19357 - RNA, 18 nt, artificial
  Chemically synthesized
gcucauacccugauggcu

SEQ ID NO: 19358 - RNA, 18 nt, artificial
  Chemically synthesized
auuauuuccuccaaugug

SEQ ID NO: 19359 - RNA, 18 nt, artificial
  Chemically synthesized
gaagugucacuagaauac

SEQ ID NO: 19360 - RNA, 18 nt, artificial
  Chemically synthesized
gggucuccucccuccucc

SEQ ID NO: 19361 - RNA, 18 nt, artificial
  Chemically synthesized
cuccagcgaugcuucaca

SEQ ID NO: 19362 - RNA, 18 nt, artificial
  Chemically synthesized
gggaaacccuggaauggg

SEQ ID NO: 19363 - RNA, 18 nt, artificial
  Chemically synthesized
cgggcuuccuucaggacc

SEQ ID NO: 19364 - RNA, 18 nt, artificial
  Chemically synthesized
gcagcccugugccaguug

SEQ ID NO: 19365 - RNA, 18 nt, artificial
  Chemically synthesized
auggaugcugugacaucu

SEQ ID NO: 19366 - RNA, 18 nt, artificial
  Chemically synthesized
cccaggcggcgcuauagu

SEQ ID NO: 19367 - RNA, 18 nt, artificial
  Chemically synthesized
cugacugaucagcaagaa

SEQ ID NO: 19368 - RNA, 18 nt, artificial
  Chemically synthesized
cccaucaggcuuccauua

SEQ ID NO: 19369 - RNA, 18 nt, artificial
  Chemically synthesized
uccuuauaggacaggcaa

SEQ ID NO: 19370 - RNA, 18 nt, artificial
  Chemically synthesized
gcguuaucugcagacacu

SEQ ID NO: 19371 - RNA, 18 nt, artificial
  Chemically synthesized
cccacaggcucugcucca

SEQ ID NO: 19372 - RNA, 18 nt, artificial
  Chemically synthesized
agacuaugacgucugcgu

SEQ ID NO: 19373 - RNA, 18 nt, artificial
  Chemically synthesized
ugaggaagccagaaauug

SEQ ID NO: 19374 - RNA, 18 nt, artificial
  Chemically synthesized
cagugaggaagaccuggu

SEQ ID NO: 19375 - RNA, 18 nt, artificial
  Chemically synthesized
ccagaaagcaccuccagc

SEQ ID NO: 19376 - RNA, 18 nt, artificial
  Chemically synthesized
caguggcaguagucgcug

SEQ ID NO: 19377 - RNA, 18 nt, artificial
  Chemically synthesized
ucagcaagaagccuagau

SEQ ID NO: 19378 - RNA, 18 nt, artificial
  Chemically synthesized
agccuagauugcaggccu

SEQ ID NO: 19379 - RNA, 18 nt, artificial
  Chemically synthesized
aucgauucacuucaaaga

SEQ ID NO: 19380 - RNA, 18 nt, artificial
  Chemically synthesized
ggaggugguaggaagugg

SEQ ID NO: 19381 - RNA, 18 nt, artificial
  Chemically synthesized
guucucaguaaguuuguu

SEQ ID NO: 19382 - RNA, 18 nt, artificial
  Chemically synthesized
aggucaagacugggucuc

SEQ ID NO: 19383 - RNA, 18 nt, artificial
  Chemically synthesized
gacacaaaccuagaagcc

SEQ ID NO: 19384 - RNA, 18 nt, artificial
  Chemically synthesized
gcccaagaagaggcccaa

SEQ ID NO: 19385 - RNA, 18 nt, artificial
  Chemically synthesized
gaggucaagacugggucu

SEQ ID NO: 19386 - RNA, 18 nt, artificial
  Chemically synthesized
gugggcucccuaagaaga

SEQ ID NO: 19387 - RNA, 18 nt, artificial
  Chemically synthesized
agagaaagcagcccugug

SEQ ID NO: 19388 - RNA, 18 nt, artificial
  Chemically synthesized
agaagugacucaccugac

SEQ ID NO: 19389 - RNA, 18 nt, artificial
  Chemically synthesized
gaccuggucuccuacuug

SEQ ID NO: 19390 - RNA, 18 nt, artificial
  Chemically synthesized
ccucccagcuccuggcuc

SEQ ID NO: 19391 - RNA, 18 nt, artificial
  Chemically synthesized
ccauuaaagacacaaacc

SEQ ID NO: 19392 - RNA, 18 nt, artificial
  Chemically synthesized
cagucacgucucccagcc

SEQ ID NO: 19393 - RNA, 18 nt, artificial
  Chemically synthesized
cacuucucccuaucauga

SEQ ID NO: 19394 - RNA, 18 nt, artificial
  Chemically synthesized
agcuggucaugcugagcu

SEQ ID NO: 19395 - RNA, 18 nt, artificial
  Chemically synthesized
cagaaauuggagguggua

SEQ ID NO: 19396 - RNA, 18 nt, artificial
  Chemically synthesized
agaugggaauccagggcu

SEQ ID NO: 19397 - RNA, 18 nt, artificial
  Chemically synthesized
cucauacccugauggcug

SEQ ID NO: 19398 - RNA, 18 nt, artificial
  Chemically synthesized
gaugcuucacagccuacc

SEQ ID NO: 19399 - RNA, 18 nt, artificial
  Chemically synthesized
gagucacagcgcuuugcu

SEQ ID NO: 19400 - RNA, 18 nt, artificial
  Chemically synthesized
ggccagcaggacucaucu

SEQ ID NO: 19401 - RNA, 18 nt, artificial
  Chemically synthesized
caagguuucauucaucug

SEQ ID NO: 19402 - RNA, 18 nt, artificial
  Chemically synthesized
gcuccacagaaacuuaag

SEQ ID NO: 19403 - RNA, 18 nt, artificial
  Chemically synthesized
acgcuauggcaucaucga

SEQ ID NO: 19404 - RNA, 18 nt, artificial
  Chemically synthesized
cucagcuggucaugcuga

SEQ ID NO: 19405 - RNA, 18 nt, artificial
  Chemically synthesized
gcacugagcaguagucac

SEQ ID NO: 19406 - RNA, 18 nt, artificial
  Chemically synthesized
gagugagucacagcgcuu

SEQ ID NO: 19407 - RNA, 18 nt, artificial
  Chemically synthesized
agacccugcugaagaagc

SEQ ID NO: 19408 - RNA, 18 nt, artificial
  Chemically synthesized
cgcuauaguguccgagcu

SEQ ID NO: 19409 - RNA, 18 nt, artificial
  Chemically synthesized
gcccugugccaguugcuc

SEQ ID NO: 19410 - RNA, 18 nt, artificial
  Chemically synthesized
cgcaguccgcgcagcccu

SEQ ID NO: 19411 - RNA, 18 nt, artificial
  Chemically synthesized
ugcugugacaucugggag

SEQ ID NO: 19412 - RNA, 18 nt, artificial
  Chemically synthesized
agggcucaggguucaaug

SEQ ID NO: 19413 - RNA, 18 nt, artificial
  Chemically synthesized
caccugagaucacaagcc

SEQ ID NO: 19414 - RNA, 18 nt, artificial
  Chemically synthesized
gcaacuccgggaugcaac

SEQ ID NO: 19415 - RNA, 18 nt, artificial
  Chemically synthesized
gaucaaugauggccagca

SEQ ID NO: 19416 - RNA, 18 nt, artificial
  Chemically synthesized
agcugucaugcguuaucu

SEQ ID NO: 19417 - RNA, 18 nt, artificial
  Chemically synthesized
cccaccugagcuccgauu

SEQ ID NO: 19418 - RNA, 18 nt, artificial
  Chemically synthesized
ccuaggugccauuaaaga

SEQ ID NO: 19419 - RNA, 18 nt, artificial
  Chemically synthesized
gucacgucucccagccug

SEQ ID NO: 19420 - RNA, 18 nt, artificial
  Chemically synthesized
gucugcgugugccacagu

SEQ ID NO: 19421 - RNA, 18 nt, artificial
  Chemically synthesized
caaagacuaugacgucug

SEQ ID NO: 19422 - RNA, 18 nt, artificial
  Chemically synthesized
ccacgcuauggcaucauc

SEQ ID NO: 19423 - RNA, 18 nt, artificial
  Chemically synthesized
ugcgcugcuuccugcaac

SEQ ID NO: 19424 - RNA, 18 nt, artificial
  Chemically synthesized
caccaaagagaaagcagc

SEQ ID NO: 19425 - RNA, 18 nt, artificial
  Chemically synthesized
ugacuguauuccuuauag

SEQ ID NO: 19426 - RNA, 18 nt, artificial
  Chemically synthesized
agaacaguuccucagcug

SEQ ID NO: 19427 - RNA, 18 nt, artificial
  Chemically synthesized
gugccacagugaggaaga

SEQ ID NO: 19428 - RNA, 18 nt, artificial
  Chemically synthesized
gguuucauucaucuguuc

SEQ ID NO: 19429 - RNA, 18 nt, artificial
  Chemically synthesized
cagcccucaucgcaacug

SEQ ID NO: 19430 - RNA, 18 nt, artificial
  Chemically synthesized
ugguacugaucaaugaug

SEQ ID NO: 19431 - RNA, 18 nt, artificial
  Chemically synthesized
ugggaucagagcacccau

SEQ ID NO: 19432 - RNA, 18 nt, artificial
  Chemically synthesized
caaaugugacaagaggua

SEQ ID NO: 19433 - RNA, 18 nt, artificial
  Chemically synthesized
agguggagcagagaacag

SEQ ID NO: 19434 - RNA, 18 nt, artificial
  Chemically synthesized
caguugacacuuguuaua

SEQ ID NO: 19435 - RNA, 18 nt, artificial
  Chemically synthesized
uggagcagagaacaguuc

SEQ ID NO: 19436 - RNA, 18 nt, artificial
  Chemically synthesized
aucacaagcccauggaug

SEQ ID NO: 19437 - RNA, 18 nt, artificial
  Chemically synthesized
ucaaagagcuguagggaa

SEQ ID NO: 19438 - RNA, 18 nt, artificial
  Chemically synthesized
caggcggcgcuauagugu

SEQ ID NO: 19439 - RNA, 18 nt, artificial
  Chemically synthesized
gguucaggcagacccugc

SEQ ID NO: 19440 - RNA, 18 nt, artificial
  Chemically synthesized
gcuguagggaagaugcag

SEQ ID NO: 19441 - RNA, 18 nt, artificial
  Chemically synthesized
gacacuuguuauaucaug

SEQ ID NO: 19442 - RNA, 18 nt, artificial
  Chemically synthesized
ugaagagaugggaaucca

SEQ ID NO: 19443 - RNA, 18 nt, artificial
  Chemically synthesized
cccagaaagcaccuccag

SEQ ID NO: 19444 - RNA, 18 nt, artificial
  Chemically synthesized
gaaagcaacaagaaucca

SEQ ID NO: 19445 - RNA, 18 nt, artificial
  Chemically synthesized
agaccauggagagcuugg

SEQ ID NO: 19446 - RNA, 18 nt, artificial
  Chemically synthesized
ccagggcucaggguucaa

SEQ ID NO: 19447 - RNA, 18 nt, artificial
  Chemically synthesized
gggcucaggguucaaugc

SEQ ID NO: 19448 - RNA, 18 nt, artificial
  Chemically synthesized
ccgcccaggaccuggucu

SEQ ID NO: 19449 - RNA, 18 nt, artificial
  Chemically synthesized
cuuccauuacugugggcu

SEQ ID NO: 19450 - RNA, 18 nt, artificial
  Chemically synthesized
gaagugacucaccugacu

SEQ ID NO: 19451 - RNA, 18 nt, artificial
  Chemically synthesized
ucucaguaaguuuguugu

SEQ ID NO: 19452 - RNA, 18 nt, artificial
  Chemically synthesized
aacuuaaggcugaaagag

SEQ ID NO: 19453 - RNA, 18 nt, artificial
  Chemically synthesized
ccgauucauguacuacgu

SEQ ID NO: 19454 - RNA, 18 nt, artificial
  Chemically synthesized
aagugaagagaugggaau

SEQ ID NO: 19455 - RNA, 18 nt, artificial
  Chemically synthesized
uggcaguagucgcuggag

SEQ ID NO: 19456 - RNA, 18 nt, artificial
  Chemically synthesized
aggccauucugaauaugg

SEQ ID NO: 19457 - RNA, 18 nt, artificial
  Chemically synthesized
ccuucuaaagagcugccu

SEQ ID NO: 19458 - RNA, 18 nt, artificial
  Chemically synthesized
ugcgagugacaguggcag

SEQ ID NO: 19459 - RNA, 18 nt, artificial
  Chemically synthesized
caguagucacugccgggu

SEQ ID NO: 19460 - RNA, 18 nt, artificial
  Chemically synthesized
agcaaagacuaugacguc

SEQ ID NO: 19461 - RNA, 18 nt, artificial
  Chemically synthesized
ggcuuucgucaagucaaa

SEQ ID NO: 19462 - RNA, 18 nt, artificial
  Chemically synthesized
agacacaaaccuagaagc

SEQ ID NO: 19463 - RNA, 18 nt, artificial
  Chemically synthesized
ugugacaucugggagcuu

SEQ ID NO: 19464 - RNA, 18 nt, artificial
  Chemically synthesized
ccagaucccgaauauccu

SEQ ID NO: 19465 - RNA, 18 nt, artificial
  Chemically synthesized
agugagucacagcgcuuu

SEQ ID NO: 19466 - RNA, 18 nt, artificial
  Chemically synthesized
ucgauucacuucaaagag

SEQ ID NO: 19467 - RNA, 18 nt, artificial
  Chemically synthesized
ugggcucccuaagaagac

SEQ ID NO: 19468 - RNA, 18 nt, artificial
  Chemically synthesized
gaauccaguccuucacac

SEQ ID NO: 19469 - RNA, 18 nt, artificial
  Chemically synthesized
agugacaguggcaguagu

SEQ ID NO: 19470 - RNA, 18 nt, artificial
  Chemically synthesized
agcuguagggaagaugca

SEQ ID NO: 19471 - RNA, 18 nt, artificial
  Chemically synthesized
ucacagucaccaucuuca

SEQ ID NO: 19472 - RNA, 18 nt, artificial
  Chemically synthesized
cacagucaccaucuucac

SEQ ID NO: 19473 - RNA, 18 nt, artificial
  Chemically synthesized
cgucaagucaaagaagcu

SEQ ID NO: 19474 - RNA, 18 nt, artificial
  Chemically synthesized
aagccucuaggcaagaug

SEQ ID NO: 19475 - RNA, 18 nt, artificial
  Chemically synthesized
cuuacauaggaaguccuu

SEQ ID NO: 19476 - RNA, 18 nt, artificial
  Chemically synthesized
gaagccuggcacccacuu

SEQ ID NO: 19477 - RNA, 18 nt, artificial
  Chemically synthesized
ugcuccacagaaacuuaa

SEQ ID NO: 19478 - RNA, 18 nt, artificial
  Chemically synthesized
cccaagccucagcucagu

SEQ ID NO: 19479 - RNA, 18 nt, artificial
  Chemically synthesized
uccgauucauguacuacg

SEQ ID NO: 19480 - RNA, 18 nt, artificial
  Chemically synthesized
gggcacuggcguacacug

SEQ ID NO: 19481 - RNA, 18 nt, artificial
  Chemically synthesized
ggucuuccuaguugccug

SEQ ID NO: 19482 - RNA, 18 nt, artificial
  Chemically synthesized
gcucugcuccacagaaac

SEQ ID NO: 19483 - RNA, 18 nt, artificial
  Chemically synthesized
ugacugaucagcaagaag

SEQ ID NO: 19484 - RNA, 18 nt, artificial
  Chemically synthesized
gagcuccgauucauguac

SEQ ID NO: 19485 - RNA, 18 nt, artificial
  Chemically synthesized
gcucaucacgccgggcuu

SEQ ID NO: 19486 - RNA, 18 nt, artificial
  Chemically synthesized
cugacugguucaggcaga

SEQ ID NO: 19487 - RNA, 18 nt, artificial
  Chemically synthesized
cacuagaauacuacagcc

SEQ ID NO: 19488 - RNA, 18 nt, artificial
  Chemically synthesized
gucacuagaauacuacag

SEQ ID NO: 19489 - RNA, 18 nt, artificial
  Chemically synthesized
ccuuacauaggaaguccu

SEQ ID NO: 19490 - RNA, 18 nt, artificial
  Chemically synthesized
cuacuuggaaggcagcac

SEQ ID NO: 19491 - RNA, 18 nt, artificial
  Chemically synthesized
aguccuucacacucacac

SEQ ID NO: 19492 - RNA, 18 nt, artificial
  Chemically synthesized
cagacccugcugaagaag

SEQ ID NO: 19493 - RNA, 18 nt, artificial
  Chemically synthesized
aauuggaggugguaggaa

SEQ ID NO: 19494 - RNA, 18 nt, artificial
  Chemically synthesized
ggaaggccgugaagcugg

SEQ ID NO: 19495 - RNA, 18 nt, artificial
  Chemically synthesized
cuccuacuuggaaggcag

SEQ ID NO: 19496 - RNA, 18 nt, artificial
  Chemically synthesized
gccaguugcucugccagc

SEQ ID NO: 19497 - RNA, 18 nt, artificial
  Chemically synthesized
gagguauagggagugagu

SEQ ID NO: 19498 - RNA, 18 nt, artificial
  Chemically synthesized
caucugggagcuucauca

SEQ ID NO: 19499 - RNA, 18 nt, artificial
  Chemically synthesized
gaucagagcacccaucag

SEQ ID NO: 19500 - RNA, 18 nt, artificial
  Chemically synthesized
cgugacccugggaucaga

SEQ ID NO: 19501 - RNA, 18 nt, artificial
  Chemically synthesized
aagucaaagaagcuguca

SEQ ID NO: 19502 - RNA, 18 nt, artificial
  Chemically synthesized
aagccuagaggccauucu

SEQ ID NO: 19503 - RNA, 18 nt, artificial
  Chemically synthesized
aggaaagccaugaggaag

SEQ ID NO: 19504 - RNA, 18 nt, artificial
  Chemically synthesized
ccuaaagaagugacucac

SEQ ID NO: 19505 - RNA, 18 nt, artificial
  Chemically synthesized
cugagcucauacccugau

SEQ ID NO: 19506 - RNA, 18 nt, artificial
  Chemically synthesized
gagcaagugaagagaugg

SEQ ID NO: 19507 - RNA, 18 nt, artificial
  Chemically synthesized
ugcguuaucugcagacac

SEQ ID NO: 19508 - RNA, 18 nt, artificial
  Chemically synthesized
aguugcucugccagccuu

SEQ ID NO: 19509 - RNA, 18 nt, artificial
  Chemically synthesized
agcuagaaacagaaaacc

SEQ ID NO: 19510 - RNA, 18 nt, artificial
  Chemically synthesized
agccagaaauuggaggug

SEQ ID NO: 19511 - RNA, 18 nt, artificial
  Chemically synthesized
cuggccagguggagcaga

SEQ ID NO: 19512 - RNA, 18 nt, artificial
  Chemically synthesized
gacugguucaggcagacc

SEQ ID NO: 19513 - RNA, 18 nt, artificial
  Chemically synthesized
aggacaggcaagguuuca

SEQ ID NO: 19514 - RNA, 18 nt, artificial
  Chemically synthesized
uccuccaauguguacuuu

SEQ ID NO: 19515 - RNA, 18 nt, artificial
  Chemically synthesized
ggcaucaucgaccucccu

SEQ ID NO: 19516 - RNA, 18 nt, artificial
  Chemically synthesized
cugcgugugccacaguga

SEQ ID NO: 19517 - RNA, 18 nt, artificial
  Chemically synthesized
gcguacacugguaucccu

SEQ ID NO: 19518 - RNA, 18 nt, artificial
  Chemically synthesized
ggguucaaugccuucacc

SEQ ID NO: 19519 - RNA, 18 nt, artificial
  Chemically synthesized
ugagcuccgauucaugua

SEQ ID NO: 19520 - RNA, 18 nt, artificial
  Chemically synthesized
gccucuaggcaagauggc

SEQ ID NO: 19521 - RNA, 18 nt, artificial
  Chemically synthesized
gcugugacaucugggagc

SEQ ID NO: 19522 - RNA, 18 nt, artificial
  Chemically synthesized
cagccugccacccacaca

SEQ ID NO: 19523 - RNA, 18 nt, artificial
  Chemically synthesized
agacacucaguugacacu

SEQ ID NO: 19524 - RNA, 18 nt, artificial
  Chemically synthesized
ccuuucacaggagaagug

SEQ ID NO: 19525 - RNA, 18 nt, artificial
  Chemically synthesized
ugcuccaugaggucaaga

SEQ ID NO: 19526 - RNA, 18 nt, artificial
  Chemically synthesized
gacucaucuccugccuaa

SEQ ID NO: 19527 - RNA, 18 nt, artificial
  Chemically synthesized
ucugggagcuucaucagu

SEQ ID NO: 19528 - RNA, 18 nt, artificial
  Chemically synthesized
caguccgcgcagcccuca

SEQ ID NO: 19529 - RNA, 18 nt, artificial
  Chemically synthesized
cccuggaacugggcacug

SEQ ID NO: 19530 - RNA, 18 nt, artificial
  Chemically synthesized
caguuccucagcugguca

SEQ ID NO: 19531 - RNA, 18 nt, artificial
  Chemically synthesized
aagcaacaagaauccagu

SEQ ID NO: 19532 - RNA, 18 nt, artificial
  Chemically synthesized
uacuuucacagucaccau

SEQ ID NO: 19533 - RNA, 18 nt, artificial
  Chemically synthesized
agcaguagucacugccgg

SEQ ID NO: 19534 - RNA, 18 nt, artificial
  Chemically synthesized
cuucaucaguggucuggc

SEQ ID NO: 19535 - RNA, 18 nt, artificial
  Chemically synthesized
ccgggugcugcucaucac

SEQ ID NO: 19536 - RNA, 18 nt, artificial
  Chemically synthesized
caagauggcugacugguu

SEQ ID NO: 19537 - RNA, 18 nt, artificial
  Chemically synthesized
ggcagcacugccagccug

SEQ ID NO: 19538 - RNA, 18 nt, artificial
  Chemically synthesized
ugucacuagaauacuaca

SEQ ID NO: 19539 - RNA, 18 nt, artificial
  Chemically synthesized
ccaggaaggccgugaagc

SEQ ID NO: 19540 - RNA, 18 nt, artificial
  Chemically synthesized
ucauguacuacgucgaug

SEQ ID NO: 19541 - RNA, 18 nt, artificial
  Chemically synthesized
gaagagaugggaauccag

SEQ ID NO: 19542 - RNA, 18 nt, artificial
  Chemically synthesized
ggugcugcucaucacgcc

SEQ ID NO: 19543 - RNA, 18 nt, artificial
  Chemically synthesized
ggcacuggcguacacugg

SEQ ID NO: 19544 - RNA, 18 nt, artificial
  Chemically synthesized
ugcagucagcacugcacu

SEQ ID NO: 19545 - RNA, 18 nt, artificial
  Chemically synthesized
cuuggaaggcagcacugc

SEQ ID NO: 19546 - RNA, 18 nt, artificial
  Chemically synthesized
cuuguuauaucaugggac

SEQ ID NO: 19547 - RNA, 18 nt, artificial
  Chemically synthesized
caggcuuccauuacugug

SEQ ID NO: 19548 - RNA, 18 nt, artificial
  Chemically synthesized
cucaggguucaaugccuu

SEQ ID NO: 19549 - RNA, 18 nt, artificial
  Chemically synthesized
cccuaggaaagccaugag

SEQ ID NO: 19550 - RNA, 18 nt, artificial
  Chemically synthesized
ggcccugaugguggcuuu

SEQ ID NO: 19551 - RNA, 18 nt, artificial
  Chemically synthesized
gacaguggcaguagucgc

SEQ ID NO: 19552 - RNA, 18 nt, artificial
  Chemically synthesized
ggcuuccauuacuguggg

SEQ ID NO: 19553 - RNA, 18 nt, artificial
  Chemically synthesized
ugccuucaccugagauca

SEQ ID NO: 19554 - RNA, 18 nt, artificial
  Chemically synthesized
uggugcaaguaccagaug

SEQ ID NO: 19555 - RNA, 18 nt, artificial
  Chemically synthesized
cacuggcguacacuggua

SEQ ID NO: 19556 - RNA, 18 nt, artificial
  Chemically synthesized
caagaagaggcccaacuc

SEQ ID NO: 19557 - RNA, 18 nt, artificial
  Chemically synthesized
gagaaagcagcccugugc

SEQ ID NO: 19558 - RNA, 18 nt, artificial
  Chemically synthesized
cucccagcuccuggcucu

SEQ ID NO: 19559 - RNA, 18 nt, artificial
  Chemically synthesized
caguccuucacacucaca

SEQ ID NO: 19560 - RNA, 18 nt, artificial
  Chemically synthesized
gcagacccugcugaagaa

SEQ ID NO: 19561 - RNA, 18 nt, artificial
  Chemically synthesized
gcacccaucaggcuucca

SEQ ID NO: 19562 - RNA, 18 nt, artificial
  Chemically synthesized
uccaguccuucacacuca

SEQ ID NO: 19563 - RNA, 18 nt, artificial
  Chemically synthesized
ccuccuaaagaagugacu

SEQ ID NO: 19564 - RNA, 18 nt, artificial
  Chemically synthesized
gacaucugggagcuucau

SEQ ID NO: 19565 - RNA, 18 nt, artificial
  Chemically synthesized
cccagaucccgaauaucc

SEQ ID NO: 19566 - RNA, 18 nt, artificial
  Chemically synthesized
uggacugggaagaaucac

SEQ ID NO: 19567 - RNA, 18 nt, artificial
  Chemically synthesized
guugcucugccagccuuu

SEQ ID NO: 19568 - RNA, 18 nt, artificial
  Chemically synthesized
acuuucacagucaccauc

SEQ ID NO: 19569 - RNA, 18 nt, artificial
  Chemically synthesized
uggcuaaagcugauacuu

SEQ ID NO: 19570 - RNA, 18 nt, artificial
  Chemically synthesized
gaauccagggcucagggu

SEQ ID NO: 19571 - RNA, 18 nt, artificial
  Chemically synthesized
ccucaccauggauggucu

SEQ ID NO: 19572 - RNA, 18 nt, artificial
  Chemically synthesized
aucugcagacacucaguu

SEQ ID NO: 19573 - RNA, 18 nt, artificial
  Chemically synthesized
cacaggacagcccacuac

SEQ ID NO: 19574 - RNA, 18 nt, artificial
  Chemically synthesized
aggcggcgcuauaguguc

SEQ ID NO: 19575 - RNA, 18 nt, artificial
  Chemically synthesized
ucaccuuuggacugggaa

SEQ ID NO: 19576 - RNA, 18 nt, artificial
  Chemically synthesized
cacaaaugugacaagagg

SEQ ID NO: 19577 - RNA, 18 nt, artificial
  Chemically synthesized
ggaagccuggcacccacu

SEQ ID NO: 19578 - RNA, 18 nt, artificial
  Chemically synthesized
acuucucccuaucaugac

SEQ ID NO: 19579 - RNA, 18 nt, artificial
  Chemically synthesized
cacacuacucuguuccuc

SEQ ID NO: 19580 - RNA, 18 nt, artificial
  Chemically synthesized
gaagcugucaugcguuau

SEQ ID NO: 19581 - RNA, 18 nt, artificial
  Chemically synthesized
ucaucuguucucaguaag

SEQ ID NO: 19582 - RNA, 18 nt, artificial
  Chemically synthesized
aaaccuagaagccuagag

SEQ ID NO: 19583 - RNA, 18 nt, artificial
  Chemically synthesized
acccacacaugcgaguga

SEQ ID NO: 19584 - RNA, 18 nt, artificial
  Chemically synthesized
gucagcacugcacuguau

SEQ ID NO: 19585 - RNA, 18 nt, artificial
  Chemically synthesized
gcuucaucaguggucugg

SEQ ID NO: 19586 - RNA, 18 nt, artificial
  Chemically synthesized
acugggaagaaucaccau

SEQ ID NO: 19587 - RNA, 18 nt, artificial
  Chemically synthesized
ucagcacugcacuguauu

SEQ ID NO: 19588 - RNA, 18 nt, artificial
  Chemically synthesized
cgaugcuucacagccuac

SEQ ID NO: 19589 - RNA, 18 nt, artificial
  Chemically synthesized
accucacaggacagccca

SEQ ID NO: 19590 - RNA, 18 nt, artificial
  Chemically synthesized
guggagggagcaagugaa

SEQ ID NO: 19591 - RNA, 18 nt, artificial
  Chemically synthesized
ccuggaacugggcacugg

SEQ ID NO: 19592 - RNA, 18 nt, artificial
  Chemically synthesized
ugaggucaagacuggguc

SEQ ID NO: 19593 - RNA, 18 nt, artificial
  Chemically synthesized
aguccuucuaaagagcug

SEQ ID NO: 19594 - RNA, 18 nt, artificial
  Chemically synthesized
ccaaagagaaagcagccc

SEQ ID NO: 19595 - RNA, 18 nt, artificial
  Chemically synthesized
acuguauuccuuauagga

SEQ ID NO: 19596 - RNA, 18 nt, artificial
  Chemically synthesized
gaggccauucugaauaug

SEQ ID NO: 19597 - RNA, 18 nt, artificial
  Chemically synthesized
ccugagcuccgauucaug

SEQ ID NO: 19598 - RNA, 18 nt, artificial
  Chemically synthesized
cccaagaagaggcccaac

SEQ ID NO: 19599 - RNA, 18 nt, artificial
  Chemically synthesized
gugccaguugcucugcca

SEQ ID NO: 19600 - RNA, 18 nt, artificial
  Chemically synthesized
ccaggaccuggucuccua

SEQ ID NO: 19601 - RNA, 18 nt, artificial
  Chemically synthesized
aggguucaaugccuucac

SEQ ID NO: 19602 - RNA, 18 nt, artificial
  Chemically synthesized
ccucagcucagucacguc

SEQ ID NO: 19603 - RNA, 18 nt, artificial
  Chemically synthesized
agccucagcucagucacg

SEQ ID NO: 19604 - RNA, 18 nt, artificial
  Chemically synthesized
gacccugcugaagaagcc

SEQ ID NO: 19605 - RNA, 18 nt, artificial
  Chemically synthesized
agucgcuggagcaaagac

SEQ ID NO: 19606 - RNA, 18 nt, artificial
  Chemically synthesized
ugcaacuccgggaugcaa

SEQ ID NO: 19607 - RNA, 18 nt, artificial
  Chemically synthesized
ucuucccagagacaucga

SEQ ID NO: 19608 - RNA, 18 nt, artificial
  Chemically synthesized
ccuggcacccacuucugu

SEQ ID NO: 19609 - RNA, 18 nt, artificial
  Chemically synthesized
cacaugcgagugacagug

SEQ ID NO: 19610 - RNA, 18 nt, artificial
  Chemically synthesized
caccauggauggucuucc

SEQ ID NO: 19611 - RNA, 18 nt, artificial
  Chemically synthesized
ggaaggcagcacugccag

SEQ ID NO: 19612 - RNA, 18 nt, artificial
  Chemically synthesized
ccaggcacugagcaguag

SEQ ID NO: 19613 - RNA, 18 nt, artificial
  Chemically synthesized
gacuaugacgucugcgug

SEQ ID NO: 19614 - RNA, 18 nt, artificial
  Chemically synthesized
agccugccacccacacau

SEQ ID NO: 19615 - RNA, 18 nt, artificial
  Chemically synthesized
cacuacucuguuccucuu

SEQ ID NO: 19616 - RNA, 18 nt, artificial
  Chemically synthesized
agccugcgcugcuuccug

SEQ ID NO: 19617 - RNA, 18 nt, artificial
  Chemically synthesized
acugguaucccuccuaaa

SEQ ID NO: 19618 - RNA, 18 nt, artificial
  Chemically synthesized
gugcaaguaccagaugcu

SEQ ID NO: 19619 - RNA, 18 nt, artificial
  Chemically synthesized
cacugagcaguagucacu

SEQ ID NO: 19620 - RNA, 18 nt, artificial
  Chemically synthesized
ucagcucagucacgucuc

SEQ ID NO: 19621 - RNA, 18 nt, artificial
  Chemically synthesized
aggugguaggaaguggua

SEQ ID NO: 19622 - RNA, 18 nt, artificial
  Chemically synthesized
caggcagacccugcugaa

SEQ ID NO: 19623 - RNA, 18 nt, artificial
  Chemically synthesized
cuggaaugggcaucagga

SEQ ID NO: 19624 - RNA, 18 nt, artificial
  Chemically synthesized
uggucuccuacuuggaag

SEQ ID NO: 19625 - RNA, 18 nt, artificial
  Chemically synthesized
ccacccacacaugcgagu

SEQ ID NO: 19626 - RNA, 18 nt, artificial
  Chemically synthesized
cugaaagaguguccgcca

SEQ ID NO: 19627 - RNA, 18 nt, artificial
  Chemically synthesized
ugauacuuucacagucac

SEQ ID NO: 19628 - RNA, 18 nt, artificial
  Chemically synthesized
uucucaguaaguuuguug

SEQ ID NO: 19629 - RNA, 18 nt, artificial
  Chemically synthesized
guggcaguagucgcugga

SEQ ID NO: 19630 - RNA, 18 nt, artificial
  Chemically synthesized
cuggagcaaagacuauga

SEQ ID NO: 19631 - RNA, 18 nt, artificial
  Chemically synthesized
agaggccauucugaauau

SEQ ID NO: 19632 - RNA, 18 nt, artificial
  Chemically synthesized
gaacaguuccucagcugg

SEQ ID NO: 19633 - RNA, 18 nt, artificial
  Chemically synthesized
ccagcuccuggcucucgg

SEQ ID NO: 19634 - RNA, 18 nt, artificial
  Chemically synthesized
ugacaguggcaguagucg

SEQ ID NO: 19635 - RNA, 18 nt, artificial
  Chemically synthesized
caagaaggccaugaggaa

SEQ ID NO: 19636 - RNA, 18 nt, artificial
  Chemically synthesized
cguacacugguaucccuc

SEQ ID NO: 19637 - RNA, 18 nt, artificial
  Chemically synthesized
aagagaaagcagcccugu

SEQ ID NO: 19638 - RNA, 18 nt, artificial
  Chemically synthesized
agccucuaggcaagaugg

SEQ ID NO: 19639 - RNA, 18 nt, artificial
  Chemically synthesized
guacuacgucgauggcag

SEQ ID NO: 19640 - RNA, 18 nt, artificial
  Chemically synthesized
ccuuauaggacaggcaag

SEQ ID NO: 19641 - RNA, 18 nt, artificial
  Chemically synthesized
aguagucacugccgggug

SEQ ID NO: 19642 - RNA, 18 nt, artificial
  Chemically synthesized
uccaugaggucaagacug

SEQ ID NO: 19643 - RNA, 18 nt, artificial
  Chemically synthesized
ucaccaucuucaccuuug

SEQ ID NO: 19644 - RNA, 18 nt, artificial
  Chemically synthesized
cagcaggacucaucuccu

SEQ ID NO: 19645 - RNA, 18 nt, artificial
  Chemically synthesized
ggaaagccaugaggaagc

SEQ ID NO: 19646 - RNA, 18 nt, artificial
  Chemically synthesized
ucacuagaauacuacagc

SEQ ID NO: 19647 - RNA, 18 nt, artificial
  Chemically synthesized
uggaugcugugacaucug

SEQ ID NO: 19648 - RNA, 18 nt, artificial
  Chemically synthesized
agagcugccuacccaccu

SEQ ID NO: 19649 - RNA, 18 nt, artificial
  Chemically synthesized
auggcaucaucgaccucc

SEQ ID NO: 19650 - RNA, 18 nt, artificial
  Chemically synthesized
agcaacaagaauccaguc

SEQ ID NO: 19651 - RNA, 18 nt, artificial
  Chemically synthesized
agaaagcaccuccagcga

SEQ ID NO: 19652 - RNA, 18 nt, artificial
  Chemically synthesized
ccacacaugcgagugaca

SEQ ID NO: 19653 - RNA, 18 nt, artificial
  Chemically synthesized
ugccuaggugccauuaaa

SEQ ID NO: 19654 - RNA, 18 nt, artificial
  Chemically synthesized
aggcagcacugccagccu

SEQ ID NO: 19655 - RNA, 18 nt, artificial
  Chemically synthesized
agcccucaucgcaacugg

SEQ ID NO: 19656 - RNA, 18 nt, artificial
  Chemically synthesized
gagcaguagucacugccg

SEQ ID NO: 19657 - RNA, 18 nt, artificial
  Chemically synthesized
cacagugaggaagaccug

SEQ ID NO: 19658 - RNA, 18 nt, artificial
  Chemically synthesized
aagccucagcucagucac

SEQ ID NO: 19659 - RNA, 18 nt, artificial
  Chemically synthesized
aucaggagaaagcaacaa

SEQ ID NO: 19660 - RNA, 18 nt, artificial
  Chemically synthesized
gcccugaccgaggcucca

SEQ ID NO: 19661 - RNA, 18 nt, artificial
  Chemically synthesized
cucugcuccacagaaacu

SEQ ID NO: 19662 - RNA, 18 nt, artificial
  Chemically synthesized
ccaugaggucaagacugg

SEQ ID NO: 19663 - RNA, 18 nt, artificial
  Chemically synthesized
cggccuuacauaggaagu

SEQ ID NO: 19664 - RNA, 18 nt, artificial
  Chemically synthesized
gacauccucugucacuac

SEQ ID NO: 19665 - RNA, 18 nt, artificial
  Chemically synthesized
cuuaaggcugaaagagug

SEQ ID NO: 19666 - RNA, 18 nt, artificial
  Chemically synthesized
gcacccacuucugucuuc

SEQ ID NO: 19667 - RNA, 18 nt, artificial
  Chemically synthesized
aagaccauggagagcuug

SEQ ID NO: 19668 - RNA, 18 nt, artificial
  Chemically synthesized
cagccugcgcugcuuccu

SEQ ID NO: 19669 - RNA, 18 nt, artificial
  Chemically synthesized
ccgccaucagggacaucc

SEQ ID NO: 19670 - RNA, 18 nt, artificial
  Chemically synthesized
cugucgggccucagcaga

SEQ ID NO: 19671 - RNA, 18 nt, artificial
  Chemically synthesized
caagcccauggaugcugu

SEQ ID NO: 19672 - RNA, 18 nt, artificial
  Chemically synthesized
acuucaaagagcuguagg

SEQ ID NO: 19673 - RNA, 18 nt, artificial
  Chemically synthesized
aguccgcgcagcccucau

SEQ ID NO: 19674 - RNA, 18 nt, artificial
  Chemically synthesized
gccgggcuuccuucagga

SEQ ID NO: 19675 - RNA, 18 nt, artificial
  Chemically synthesized
cucaucuccugccuaacu

SEQ ID NO: 19676 - RNA, 18 nt, artificial
  Chemically synthesized
agcagagcugccuaccca

SEQ ID NO: 19677 - RNA, 18 nt, artificial
  Chemically synthesized
acaugcgagugacagugg

SEQ ID NO: 19678 - RNA, 18 nt, artificial
  Chemically synthesized
acacaugcgagugacagu

SEQ ID NO: 19679 - RNA, 18 nt, artificial
  Chemically synthesized
cacuucaaagagcuguag

SEQ ID NO: 19680 - RNA, 18 nt, artificial
  Chemically synthesized
uggucuggcuaaagcuga

SEQ ID NO: 19681 - RNA, 18 nt, artificial
  Chemically synthesized
ugcucugccagccuuuca

SEQ ID NO: 19682 - RNA, 18 nt, artificial
  Chemically synthesized
ggcugaaagaguguccgc

SEQ ID NO: 19683 - RNA, 18 nt, artificial
  Chemically synthesized
cugugacaucugggagcu

SEQ ID NO: 19684 - RNA, 18 nt, artificial
  Chemically synthesized
gcugcaggcccugaccga

SEQ ID NO: 19685 - RNA, 18 nt, artificial
  Chemically synthesized
gauggcugcuccaugagg

SEQ ID NO: 19686 - RNA, 18 nt, artificial
  Chemically synthesized
augcugagcucauacccu

SEQ ID NO: 19687 - RNA, 18 nt, artificial
  Chemically synthesized
agugaagagaugggaauc

SEQ ID NO: 19688 - RNA, 18 nt, artificial
  Chemically synthesized
gauggucuuccuaguugc

SEQ ID NO: 19689 - RNA, 18 nt, artificial
  Chemically synthesized
uggagcaaagacuaugac

SEQ ID NO: 19690 - RNA, 18 nt, artificial
  Chemically synthesized
cagggacauccucuguca

SEQ ID NO: 19691 - RNA, 18 nt, artificial
  Chemically synthesized
caguggucuggcuaaagc

SEQ ID NO: 19692 - RNA, 18 nt, artificial
  Chemically synthesized
cccauggaugcugugaca

SEQ ID NO: 19693 - RNA, 18 nt, artificial
  Chemically synthesized
ugcucaucacgccgggcu

SEQ ID NO: 19694 - RNA, 18 nt, artificial
  Chemically synthesized
gaugguggcuuucgucaa

SEQ ID NO: 19695 - RNA, 18 nt, artificial
  Chemically synthesized
acugagcaguagucacug

SEQ ID NO: 19696 - RNA, 18 nt, artificial
  Chemically synthesized
acuagaauacuacagccc

SEQ ID NO: 19697 - RNA, 18 nt, artificial
  Chemically synthesized
cuacucuguuccucuucc

SEQ ID NO: 19698 - RNA, 18 nt, artificial
  Chemically synthesized
caaguaccagaugcugca

SEQ ID NO: 19699 - RNA, 18 nt, artificial
  Chemically synthesized
cugggucuccucccuccu

SEQ ID NO: 19700 - RNA, 18 nt, artificial
  Chemically synthesized
guaucccuccuaaagaag

SEQ ID NO: 19701 - RNA, 18 nt, artificial
  Chemically synthesized
ugagaucacaagcccaug

SEQ ID NO: 19702 - RNA, 18 nt, artificial
  Chemically synthesized
aaagaagcugucaugcgu

SEQ ID NO: 19703 - RNA, 18 nt, artificial
  Chemically synthesized
ugccagccuuucacagga

SEQ ID NO: 19704 - RNA, 18 nt, artificial
  Chemically synthesized
aacaguuccucagcuggu

SEQ ID NO: 19705 - RNA, 18 nt, artificial
  Chemically synthesized
aagaagaccauggagagc

SEQ ID NO: 19706 - RNA, 18 nt, artificial
  Chemically synthesized
cagcacugcacuguauuu

SEQ ID NO: 19707 - RNA, 18 nt, artificial
  Chemically synthesized
cgcugcuuccugcaacuc

SEQ ID NO: 19708 - RNA, 18 nt, artificial
  Chemically synthesized
acgucucccagccugcca

SEQ ID NO: 19709 - RNA, 18 nt, artificial
  Chemically synthesized
cccuccuaaagaagugac

SEQ ID NO: 19710 - RNA, 18 nt, artificial
  Chemically synthesized
gaucccgaauauccuccu

SEQ ID NO: 19711 - RNA, 18 nt, artificial
  Chemically synthesized
caaugccuucaccugaga

SEQ ID NO: 19712 - RNA, 18 nt, artificial
  Chemically synthesized
gucaugcugagcucauac

SEQ ID NO: 19713 - RNA, 18 nt, artificial
  Chemically synthesized
ugacaagagguauaggga

SEQ ID NO: 19714 - RNA, 18 nt, artificial
  Chemically synthesized
aagaagugacucaccuga

SEQ ID NO: 19715 - RNA, 18 nt, artificial
  Chemically synthesized
uggcucucggccuaagaa

SEQ ID NO: 19716 - RNA, 18 nt, artificial
  Chemically synthesized
ccuucaccaaugccuggu

SEQ ID NO: 19717 - RNA, 18 nt, artificial
  Chemically synthesized
gaagccuagaggccauuc

SEQ ID NO: 19718 - RNA, 18 nt, artificial
  Chemically synthesized
acuggcguacacugguau

SEQ ID NO: 19719 - RNA, 18 nt, artificial
  Chemically synthesized
cugauggcugcuccauga

SEQ ID NO: 19720 - RNA, 18 nt, artificial
  Chemically synthesized
cuggcacccacuucuguc

SEQ ID NO: 19721 - RNA, 18 nt, artificial
  Chemically synthesized
acacucaguugacacuug

SEQ ID NO: 19722 - RNA, 18 nt, artificial
  Chemically synthesized
accaaugccuggucucac

SEQ ID NO: 19723 - RNA, 18 nt, artificial
  Chemically synthesized
cugccagccugcgcugcu

SEQ ID NO: 19724 - RNA, 18 nt, artificial
  Chemically synthesized
guuaucugcagacacuca

SEQ ID NO: 19725 - RNA, 18 nt, artificial
  Chemically synthesized
aaacuuaaggcugaaaga

SEQ ID NO: 19726 - RNA, 18 nt, artificial
  Chemically synthesized
aggaccuggucuccuacu

SEQ ID NO: 19727 - RNA, 18 nt, artificial
  Chemically synthesized
cccuggaaugggcaucag

SEQ ID NO: 19728 - RNA, 18 nt, artificial
  Chemically synthesized
gugacccugggaucagag

SEQ ID NO: 19729 - RNA, 18 nt, artificial
  Chemically synthesized
accuagaagccuagaggc

SEQ ID NO: 19730 - RNA, 18 nt, artificial
  Chemically synthesized
acugaucaaugauggcca

SEQ ID NO: 19731 - RNA, 18 nt, artificial
  Chemically synthesized
augcguuaucugcagaca

SEQ ID NO: 19732 - RNA, 18 nt, artificial
  Chemically synthesized
uagaggccauucugaaua

SEQ ID NO: 19733 - RNA, 18 nt, artificial
  Chemically synthesized
ugucaugcguuaucugca

SEQ ID NO: 19734 - RNA, 18 nt, artificial
  Chemically synthesized
ccaggcggcgcuauagug

SEQ ID NO: 19735 - RNA, 18 nt, artificial
  Chemically synthesized
cccugggaucagagcacc

SEQ ID NO: 19736 - RNA, 18 nt, artificial
  Chemically synthesized
uaagaagaccauggagag

SEQ ID NO: 19737 - RNA, 18 nt, artificial
  Chemically synthesized
gggccgagggcugcacca

SEQ ID NO: 19738 - RNA, 18 nt, artificial
  Chemically synthesized
uaggcaagauggcugacu

SEQ ID NO: 19739 - RNA, 18 nt, artificial
  Chemically synthesized
cuaccucacaggacagcc

SEQ ID NO: 19740 - RNA, 18 nt, artificial
  Chemically synthesized
gugaggaagaccuggugg

SEQ ID NO: 19741 - RNA, 18 nt, artificial
  Chemically synthesized
caucgaccucccucccag

SEQ ID NO: 19742 - RNA, 18 nt, artificial
  Chemically synthesized
cccucaucgcaacugggc

SEQ ID NO: 19743 - RNA, 18 nt, artificial
  Chemically synthesized
agagcugccugccagcug

SEQ ID NO: 19744 - RNA, 18 nt, artificial
  Chemically synthesized
agacugggucuccucccu

SEQ ID NO: 19745 - RNA, 18 nt, artificial
  Chemically synthesized
ucauuauuuccuccaaug

SEQ ID NO: 19746 - RNA, 18 nt, artificial
  Chemically synthesized
uaggaaagccaugaggaa

SEQ ID NO: 19747 - RNA, 18 nt, artificial
  Chemically synthesized
cuccaauguguacuuuug

SEQ ID NO: 19748 - RNA, 18 nt, artificial
  Chemically synthesized
ucuggcagaugacuguau

SEQ ID NO: 19749 - RNA, 18 nt, artificial
  Chemically synthesized
ucucuaguucuagaaaga

SEQ ID NO: 19750 - RNA, 18 nt, artificial
  Chemically synthesized
ugcaaguaccagaugcug

SEQ ID NO: 19751 - RNA, 18 nt, artificial
  Chemically synthesized
cuucuaaagagcugccug

SEQ ID NO: 19752 - RNA, 18 nt, artificial
  Chemically synthesized
caagacugggucuccucc

SEQ ID NO: 19753 - RNA, 18 nt, artificial
  Chemically synthesized
agaagcugucaugcguua

SEQ ID NO: 19754 - RNA, 18 nt, artificial
  Chemically synthesized
ugccuaacuggacaggaa

SEQ ID NO: 19755 - RNA, 18 nt, artificial
  Chemically synthesized
ugcgugugccacagugag

SEQ ID NO: 19756 - RNA, 18 nt, artificial
  Chemically synthesized
aaagcugauacuuucaca

SEQ ID NO: 19757 - RNA, 18 nt, artificial
  Chemically synthesized
agaagccuagaggccauu

SEQ ID NO: 19758 - RNA, 18 nt, artificial
  Chemically synthesized
agcccugugccaguugcu

SEQ ID NO: 19759 - RNA, 18 nt, artificial
  Chemically synthesized
cccugaccgaggcuccag

SEQ ID NO: 19760 - RNA, 18 nt, artificial
  Chemically synthesized
ucgcuggagcaaagacua

SEQ ID NO: 19761 - RNA, 18 nt, artificial
  Chemically synthesized
gggaauccagggcucagg

SEQ ID NO: 19762 - RNA, 18 nt, artificial
  Chemically synthesized
ccucagcagagcugccua

SEQ ID NO: 19763 - RNA, 18 nt, artificial
  Chemically synthesized
cacacucacacuacucug

SEQ ID NO: 19764 - RNA, 18 nt, artificial
  Chemically synthesized
gggccucagcagagcugc

SEQ ID NO: 19765 - RNA, 18 nt, artificial
  Chemically synthesized
ggcaagauggcugacugg

SEQ ID NO: 19766 - RNA, 18 nt, artificial
  Chemically synthesized
guccuucuaaagagcugc

SEQ ID NO: 19767 - RNA, 18 nt, artificial
  Chemically synthesized
gugacaguggcaguaguc

SEQ ID NO: 19768 - RNA, 18 nt, artificial
  Chemically synthesized
aaagcaacaagaauccag

SEQ ID NO: 19769 - RNA, 18 nt, artificial
  Chemically synthesized
gcugagcucauacccuga

SEQ ID NO: 19770 - RNA, 18 nt, artificial
  Chemically synthesized
aaguccuucuaaagagcu

SEQ ID NO: 19771 - RNA, 18 nt, artificial
  Chemically synthesized
ucaagucaaagaagcugu

SEQ ID NO: 19772 - RNA, 18 nt, artificial
  Chemically synthesized
uccaccaaagagaaagca

SEQ ID NO: 19773 - RNA, 18 nt, artificial
  Chemically synthesized
gggcuuccuucaggaccc

SEQ ID NO: 19774 - RNA, 18 nt, artificial
  Chemically synthesized
aacaagaauccaguccuu

SEQ ID NO: 19775 - RNA, 18 nt, artificial
  Chemically synthesized
cuggugcaaguaccagau

SEQ ID NO: 19776 - RNA, 18 nt, artificial
  Chemically synthesized
ccauuacugugggcuccc

SEQ ID NO: 19777 - RNA, 18 nt, artificial
  Chemically synthesized
gucaaagaagcugucaug

SEQ ID NO: 19778 - RNA, 18 nt, artificial
  Chemically synthesized
cagcccugugccaguugc

SEQ ID NO: 19779 - RNA, 18 nt, artificial
  Chemically synthesized
aggcaagauggcugacug

SEQ ID NO: 19780 - RNA, 18 nt, artificial
  Chemically synthesized
cucugccagccuuucaca

SEQ ID NO: 19781 - RNA, 18 nt, artificial
  Chemically synthesized
augaggaagccagaaauu

SEQ ID NO: 19782 - RNA, 18 nt, artificial
  Chemically synthesized
acuuguuauaucauggga

SEQ ID NO: 19783 - RNA, 18 nt, artificial
  Chemically synthesized
cuggucaugcugagcuca

SEQ ID NO: 19784 - RNA, 18 nt, artificial
  Chemically synthesized
cccagcuccuggcucucg

SEQ ID NO: 19785 - RNA, 18 nt, artificial
  Chemically synthesized
cacgccgggcuuccuuca

SEQ ID NO: 19786 - RNA, 18 nt, artificial
  Chemically synthesized
cacaagcccauggaugcu

SEQ ID NO: 19787 - RNA, 18 nt, artificial
  Chemically synthesized
ugggcacuggcguacacu

SEQ ID NO: 19788 - RNA, 18 nt, artificial
  Chemically synthesized
ccuagauugcaggccuca

SEQ ID NO: 19789 - RNA, 18 nt, artificial
  Chemically synthesized
gccagccugcgcugcuuc

SEQ ID NO: 19790 - RNA, 18 nt, artificial
  Chemically synthesized
cgucucccagccugccac

SEQ ID NO: 19791 - RNA, 18 nt, artificial
  Chemically synthesized
gcgcugcuuccugcaacu

SEQ ID NO: 19792 - RNA, 18 nt, artificial
  Chemically synthesized
uccuaaagaagugacuca

SEQ ID NO: 19793 - RNA, 18 nt, artificial
  Chemically synthesized
cuuccugcaacuccggga

SEQ ID NO: 19794 - RNA, 18 nt, artificial
  Chemically synthesized
uucacagccuaccucaca

SEQ ID NO: 19795 - RNA, 18 nt, artificial
  Chemically synthesized
acaagcccauggaugcug

SEQ ID NO: 19796 - RNA, 18 nt, artificial
  Chemically synthesized
agcugugccaggcacuga

SEQ ID NO: 19797 - RNA, 18 nt, artificial
  Chemically synthesized
uauaggacaggcaagguu

SEQ ID NO: 19798 - RNA, 18 nt, artificial
  Chemically synthesized
cgccaucagggacauccu

SEQ ID NO: 19799 - RNA, 18 nt, artificial
  Chemically synthesized
caccaaugccuggucuca

SEQ ID NO: 19800 - RNA, 18 nt, artificial
  Chemically synthesized
gcacugccagccugcgcu

SEQ ID NO: 19801 - RNA, 18 nt, artificial
  Chemically synthesized
gauugcaggccucaccau

SEQ ID NO: 19802 - RNA, 18 nt, artificial
  Chemically synthesized
agaccugguggccgccca

SEQ ID NO: 19803 - RNA, 18 nt, artificial
  Chemically synthesized
gccacccacacaugcgag

SEQ ID NO: 19804 - RNA, 18 nt, artificial
  Chemically synthesized
aggaagaccugguggccg

SEQ ID NO: 19805 - RNA, 18 nt, artificial
  Chemically synthesized
gaccauggagagcuuggg

SEQ ID NO: 19806 - RNA, 18 nt, artificial
  Chemically synthesized
cuucacacucacacuacu

SEQ ID NO: 19807 - RNA, 18 nt, artificial
  Chemically synthesized
cugguucaggcagacccu

SEQ ID NO: 19808 - RNA, 18 nt, artificial
  Chemically synthesized
uccaauguguacuuuugu

SEQ ID NO: 19809 - RNA, 18 nt, artificial
  Chemically synthesized
aucagcaagaagccuaga

SEQ ID NO: 19810 - RNA, 18 nt, artificial
  Chemically synthesized
acugccgggugcugcuca

SEQ ID NO: 19811 - RNA, 18 nt, artificial
  Chemically synthesized
acugguucaggcagaccc

SEQ ID NO: 19812 - RNA, 18 nt, artificial
  Chemically synthesized
acuacucuguuccucuuc

SEQ ID NO: 19813 - RNA, 18 nt, artificial
  Chemically synthesized
gucuggcuaaagcugaua

SEQ ID NO: 19814 - RNA, 18 nt, artificial
  Chemically synthesized
agcucauacccugauggc

SEQ ID NO: 19815 - RNA, 18 nt, artificial
  Chemically synthesized
gcagcccucaucgcaacu

SEQ ID NO: 19816 - RNA, 18 nt, artificial
  Chemically synthesized
gugguaggaagugguacu

SEQ ID NO: 19817 - RNA, 18 nt, artificial
  Chemically synthesized
uuucacagucaccaucuu

SEQ ID NO: 19818 - RNA, 18 nt, artificial
  Chemically synthesized
aggaagccagaaauugga

SEQ ID NO: 19819 - RNA, 18 nt, artificial
  Chemically synthesized
auucuuguugcuuucucc

SEQ ID NO: 19820 - RNA, 18 nt, artificial
  Chemically synthesized
aaaguaucagcuuuagcc

SEQ ID NO: 19821 - RNA, 18 nt, artificial
  Chemically synthesized
acuguucucugcuccacc

SEQ ID NO: 19822 - RNA, 18 nt, artificial
  Chemically synthesized
uucuagugacacuucucc

SEQ ID NO: 19823 - RNA, 18 nt, artificial
  Chemically synthesized
uucacuccaauuuccggg

SEQ ID NO: 19824 - RNA, 18 nt, artificial
  Chemically synthesized
ucuccauggucuucuuag

SEQ ID NO: 19825 - RNA, 18 nt, artificial
  Chemically synthesized
uuucuguggagcagagcc

SEQ ID NO: 19826 - RNA, 18 nt, artificial
  Chemically synthesized
caacuaggaagaccaucc

SEQ ID NO: 19827 - RNA, 18 nt, artificial
  Chemically synthesized
uuugugggaauccgaggc

SEQ ID NO: 19828 - RNA, 18 nt, artificial
  Chemically synthesized
agcucuccauggucuucu

SEQ ID NO: 19829 - RNA, 18 nt, artificial
  Chemically synthesized
aucucuucacuugcuccc

SEQ ID NO: 19830 - RNA, 18 nt, artificial
  Chemically synthesized
aaucuaggcuucuugcug

SEQ ID NO: 19831 - RNA, 18 nt, artificial
  Chemically synthesized
agauggugacugugaaag

SEQ ID NO: 19832 - RNA, 18 nt, artificial
  Chemically synthesized
uagggagaagugagaggg

SEQ ID NO: 19833 - RNA, 18 nt, artificial
  Chemically synthesized
aaaaauggugauucuucc

SEQ ID NO: 19834 - RNA, 18 nt, artificial
  Chemically synthesized
ugaggaacuguucucugc

SEQ ID NO: 19835 - RNA, 18 nt, artificial
  Chemically synthesized
cucuuuagaaggacuucc

SEQ ID NO: 19836 - RNA, 18 nt, artificial
  Chemically synthesized
gugcugacugcaucuucc

SEQ ID NO: 19837 - RNA, 18 nt, artificial
  Chemically synthesized
ugaaugaaaccuugccug

SEQ ID NO: 19838 - RNA, 18 nt, artificial
  Chemically synthesized
gugaaucgaugucucugg

SEQ ID NO: 19839 - RNA, 18 nt, artificial
  Chemically synthesized
aaaaguacacauuggagg

SEQ ID NO: 19840 - RNA, 18 nt, artificial
  Chemically synthesized
uuuucuguuucuagcuuc

SEQ ID NO: 19841 - RNA, 18 nt, artificial
  Chemically synthesized
acugugaaaguaucagcu

SEQ ID NO: 19842 - RNA, 18 nt, artificial
  Chemically synthesized
augaaaccuugccugucc

SEQ ID NO: 19843 - RNA, 18 nt, artificial
  Chemically synthesized
aagugucaacugaguguc

SEQ ID NO: 19844 - RNA, 18 nt, artificial
  Chemically synthesized
ucaguaccacuuccuacc

SEQ ID NO: 19845 - RNA, 18 nt, artificial
  Chemically synthesized
uagcuucacuccaauuuc

SEQ ID NO: 19846 - RNA, 18 nt, artificial
  Chemically synthesized
ugacuacugcucagugcc

SEQ ID NO: 19847 - RNA, 18 nt, artificial
  Chemically synthesized
ugcaaucuaggcuucuug

SEQ ID NO: 19848 - RNA, 18 nt, artificial
  Chemically synthesized
auuugugggaauccgagg

SEQ ID NO: 19849 - RNA, 18 nt, artificial
  Chemically synthesized
cuacugccacugucacuc

SEQ ID NO: 19850 - RNA, 18 nt, artificial
  Chemically synthesized
ugcugacugcaucuuccc

SEQ ID NO: 19851 - RNA, 18 nt, artificial
  Chemically synthesized
uugcucccuccaccaccc

SEQ ID NO: 19852 - RNA, 18 nt, artificial
  Chemically synthesized
ucuucacuugcucccucc

SEQ ID NO: 19853 - RNA, 18 nt, artificial
  Chemically synthesized
uugcuuucuccugaugcc

SEQ ID NO: 19854 - RNA, 18 nt, artificial
  Chemically synthesized
ggaacuguucucugcucc

SEQ ID NO: 19855 - RNA, 18 nt, artificial
  Chemically synthesized
guucaacaacaaacuuac

SEQ ID NO: 19856 - RNA, 18 nt, artificial
  Chemically synthesized
augaaugaaaccuugccu

SEQ ID NO: 19857 - RNA, 18 nt, artificial
  Chemically synthesized
cgucauagucuuugcucc

SEQ ID NO: 19858 - RNA, 18 nt, artificial
  Chemically synthesized
uauucuagugacacuucu

SEQ ID NO: 19859 - RNA, 18 nt, artificial
  Chemically synthesized
uugccuagaggcuucuua

SEQ ID NO: 19860 - RNA, 18 nt, artificial
  Chemically synthesized
aauggugauucuucccag

SEQ ID NO: 19861 - RNA, 18 nt, artificial
  Chemically synthesized
ugagguaggcugugaagc

SEQ ID NO: 19862 - RNA, 18 nt, artificial
  Chemically synthesized
aggugaagauggugacug

SEQ ID NO: 19863 - RNA, 18 nt, artificial
  Chemically synthesized
uaaggaauacagucaucu

SEQ ID NO: 19864 - RNA, 18 nt, artificial
  Chemically synthesized
auucuucccaguccaaag

SEQ ID NO: 19865 - RNA, 18 nt, artificial
  Chemically synthesized
ugaugggugcucugaucc

SEQ ID NO: 19866 - RNA, 18 nt, artificial
  Chemically synthesized
agacgucauagucuuugc

SEQ ID NO: 19867 - RNA, 18 nt, artificial
  Chemically synthesized
uugcgaugagggcugcgc

SEQ ID NO: 19868 - RNA, 18 nt, artificial
  Chemically synthesized
agaacagaugaaugaaac

SEQ ID NO: 19869 - RNA, 18 nt, artificial
  Chemically synthesized
aggacuggauucuuguug

SEQ ID NO: 19870 - RNA, 18 nt, artificial
  Chemically synthesized
agcugaggaacuguucuc

SEQ ID NO: 19871 - RNA, 18 nt, artificial
  Chemically synthesized
acacuucuccugugaaag

SEQ ID NO: 19872 - RNA, 18 nt, artificial
  Chemically synthesized
augucucugggaagagga

SEQ ID NO: 19873 - RNA, 18 nt, artificial
  Chemically synthesized
caucucuucacuugcucc

SEQ ID NO: 19874 - RNA, 18 nt, artificial
  Chemically synthesized
ucuugucacauuuguggg

SEQ ID NO: 19875 - RNA, 18 nt, artificial
  Chemically synthesized
uguuucuagcuucacucc

SEQ ID NO: 19876 - RNA, 18 nt, artificial
  Chemically synthesized
ucuucuugggcuucuuca

SEQ ID NO: 19877 - RNA, 18 nt, artificial
  Chemically synthesized
uucucugcuccaccuggc

SEQ ID NO: 19878 - RNA, 18 nt, artificial
  Chemically synthesized
gaugaaugaaaccuugcc

SEQ ID NO: 19879 - RNA, 18 nt, artificial
  Chemically synthesized
ugaugagcagcacccggc

SEQ ID NO: 19880 - RNA, 18 nt, artificial
  Chemically synthesized
uucuugggcuucuucagc

SEQ ID NO: 19881 - RNA, 18 nt, artificial
  Chemically synthesized
uagugacagaggaugucc

SEQ ID NO: 19882 - RNA, 18 nt, artificial
  Chemically synthesized
ggcauugaacccugagcc

SEQ ID NO: 19883 - RNA, 18 nt, artificial
  Chemically synthesized
uuugguggaucugcgcgc

SEQ ID NO: 19884 - RNA, 18 nt, artificial
  Chemically synthesized
cucggacacuauagcgcc

SEQ ID NO: 19885 - RNA, 18 nt, artificial
  Chemically synthesized
agaugaaugaaaccuugc

SEQ ID NO: 19886 - RNA, 18 nt, artificial
  Chemically synthesized
cuagaggcuucuuaggcc

SEQ ID NO: 19887 - RNA, 18 nt, artificial
  Chemically synthesized
uagaggcuucuuaggccg

SEQ ID NO: 19888 - RNA, 18 nt, artificial
  Chemically synthesized
acgugacugagcugaggc

SEQ ID NO: 19889 - RNA, 18 nt, artificial
  Chemically synthesized
ugaaucgaugucucuggg

SEQ ID NO: 19890 - RNA, 18 nt, artificial
  Chemically synthesized
uaggcuucuagguuugug

SEQ ID NO: 19891 - RNA, 18 nt, artificial
  Chemically synthesized
gaccacugaugaagcucc

SEQ ID NO: 19892 - RNA, 18 nt, artificial
  Chemically synthesized
aaaauggugauucuuccc

SEQ ID NO: 19893 - RNA, 18 nt, artificial
  Chemically synthesized
uuucuggcuuccucaugg

SEQ ID NO: 19894 - RNA, 18 nt, artificial
  Chemically synthesized
augauagggagaagugag

SEQ ID NO: 19895 - RNA, 18 nt, artificial
  Chemically synthesized
uccauggucuucuuaggg

SEQ ID NO: 19896 - RNA, 18 nt, artificial
  Chemically synthesized
augucacagcauccaugg

SEQ ID NO: 19897 - RNA, 18 nt, artificial
  Chemically synthesized
cucuugucacauuugugg

SEQ ID NO: 19898 - RNA, 18 nt, artificial
  Chemically synthesized
acuucuccugugaaaggc

SEQ ID NO: 19899 - RNA, 18 nt, artificial
  Chemically synthesized
ucuuuagaaggacuuccu

SEQ ID NO: 19900 - RNA, 18 nt, artificial
  Chemically synthesized
acgucauagucuuugcuc

SEQ ID NO: 19901 - RNA, 18 nt, artificial
  Chemically synthesized
uuugcuccagcgacuacu

SEQ ID NO: 19902 - RNA, 18 nt, artificial
  Chemically synthesized
uggucuucuuagggagcc

SEQ ID NO: 19903 - RNA, 18 nt, artificial
  Chemically synthesized
aagugaaucgaugucucu

SEQ ID NO: 19904 - RNA, 18 nt, artificial
  Chemically synthesized
augacagcuucuuugacu

SEQ ID NO: 19905 - RNA, 18 nt, artificial
  Chemically synthesized
acucuuucagccuuaagu

SEQ ID NO: 19906 - RNA, 18 nt, artificial
  Chemically synthesized
cuucuuaggccgagagcc

SEQ ID NO: 19907 - RNA, 18 nt, artificial
  Chemically synthesized
uaggcuucuugcugauca

SEQ ID NO: 19908 - RNA, 18 nt, artificial
  Chemically synthesized
aggugaaggcauugaacc

SEQ ID NO: 19909 - RNA, 18 nt, artificial
  Chemically synthesized
uggccucuaggcuucuag

SEQ ID NO: 19910 - RNA, 18 nt, artificial
  Chemically synthesized
ucucugggaagaggaaca

SEQ ID NO: 19911 - RNA, 18 nt, artificial
  Chemically synthesized
aagacagaagugggugcc

SEQ ID NO: 19912 - RNA, 18 nt, artificial
  Chemically synthesized
uaacaagugucaacugag

SEQ ID NO: 19913 - RNA, 18 nt, artificial
  Chemically synthesized
agaccacugaugaagcuc

SEQ ID NO: 19914 - RNA, 18 nt, artificial
  Chemically synthesized
aagcaucgcuggaggugc

SEQ ID NO: 19915 - RNA, 18 nt, artificial
  Chemically synthesized
agugaaucgaugucucug

SEQ ID NO: 19916 - RNA, 18 nt, artificial
  Chemically synthesized
ugucaacugagugucugc

SEQ ID NO: 19917 - RNA, 18 nt, artificial
  Chemically synthesized
cugcuuucucuuuggugg

SEQ ID NO: 19918 - RNA, 18 nt, artificial
  Chemically synthesized
ugacugugaaaguaucag

SEQ ID NO: 19919 - RNA, 18 nt, artificial
  Chemically synthesized
uugaucaguaccacuucc

SEQ ID NO: 19920 - RNA, 18 nt, artificial
  Chemically synthesized
uaugagcucagcaugacc

SEQ ID NO: 19921 - RNA, 18 nt, artificial
  Chemically synthesized
ucaacugagugucugcag

SEQ ID NO: 19922 - RNA, 18 nt, artificial
  Chemically synthesized
gggauaccaguguacgcc

SEQ ID NO: 19923 - RNA, 18 nt, artificial
  Chemically synthesized
uucuuguugcuuucuccu

SEQ ID NO: 19924 - RNA, 18 nt, artificial
  Chemically synthesized
gcaucugguacuugcacc

SEQ ID NO: 19925 - RNA, 18 nt, artificial
  Chemically synthesized
cugaggaacuguucucug

SEQ ID NO: 19926 - RNA, 18 nt, artificial
  Chemically synthesized
ucacagcauccaugggcu

SEQ ID NO: 19927 - RNA, 18 nt, artificial
  Chemically synthesized
uggccaggaggauauucg

SEQ ID NO: 19928 - RNA, 18 nt, artificial
  Chemically synthesized
agucuugaccucauggag

SEQ ID NO: 19929 - RNA, 18 nt, artificial
  Chemically synthesized
ugaaggacuggauucuug

SEQ ID NO: 19930 - RNA, 18 nt, artificial
  Chemically synthesized
agagcaacuggcacaggg

SEQ ID NO: 19931 - RNA, 18 nt, artificial
  Chemically synthesized
auggagcagccaucaggg

SEQ ID NO: 19932 - RNA, 18 nt, artificial
  Chemically synthesized
agacgugacugagcugag

SEQ ID NO: 19933 - RNA, 18 nt, artificial
  Chemically synthesized
ggaauacagucaucugcc

SEQ ID NO: 19934 - RNA, 18 nt, artificial
  Chemically synthesized
guaccacuuccuaccacc

SEQ ID NO: 19935 - RNA, 18 nt, artificial
  Chemically synthesized
aaauggugauucuuccca

SEQ ID NO: 19936 - RNA, 18 nt, artificial
  Chemically synthesized
aaaggugaagauggugac

SEQ ID NO: 19937 - RNA, 18 nt, artificial
  Chemically synthesized
ggaguugcaggaagcagc

SEQ ID NO: 19938 - RNA, 18 nt, artificial
  Chemically synthesized
ggacuggauucuuguugc

SEQ ID NO: 19939 - RNA, 18 nt, artificial
  Chemically synthesized
gcuucacuccaauuuccg

SEQ ID NO: 19940 - RNA, 18 nt, artificial
  Chemically synthesized
guccaaaggugaagaugg

SEQ ID NO: 19941 - RNA, 18 nt, artificial
  Chemically synthesized
aucuugccuagaggcuuc

SEQ ID NO: 19942 - RNA, 18 nt, artificial
  Chemically synthesized
uugaccucauggagcagc

SEQ ID NO: 19943 - RNA, 18 nt, artificial
  Chemically synthesized
uacugccacugucacucg

SEQ ID NO: 19944 - RNA, 18 nt, artificial
  Chemically synthesized
ugacucacucccuauacc

SEQ ID NO: 19945 - RNA, 18 nt, artificial
  Chemically synthesized
guaauggaagccugaugg

SEQ ID NO: 19946 - RNA, 18 nt, artificial
  Chemically synthesized
aucgaugucucugggaag

SEQ ID NO: 19947 - RNA, 18 nt, artificial
  Chemically synthesized
cauggucuucuuagggag

SEQ ID NO: 19948 - RNA, 18 nt, artificial
  Chemically synthesized
aaugaaaccuugccuguc

SEQ ID NO: 19949 - RNA, 18 nt, artificial
  Chemically synthesized
augaugccauagcguggg

SEQ ID NO: 19950 - RNA, 18 nt, artificial
  Chemically synthesized
uaggcugugaagcaucgc

SEQ ID NO: 19951 - RNA, 18 nt, artificial
  Chemically synthesized
gucuugaccucauggagc

SEQ ID NO: 19952 - RNA, 18 nt, artificial
  Chemically synthesized
aacaacaaacuuacugag

SEQ ID NO: 19953 - RNA, 18 nt, artificial
  Chemically synthesized
cucuucuugggcuucuuc

SEQ ID NO: 19954 - RNA, 18 nt, artificial
  Chemically synthesized
gcgugaugagcagcaccc

SEQ ID NO: 19955 - RNA, 18 nt, artificial
  Chemically synthesized
ccuagaggcuucuuaggc

SEQ ID NO: 19956 - RNA, 18 nt, artificial
  Chemically synthesized
acauuggaggaaauaaug

SEQ ID NO: 19957 - RNA, 18 nt, artificial
  Chemically synthesized
aaguaggagaccaggucc

SEQ ID NO: 19958 - RNA, 18 nt, artificial
  Chemically synthesized
uugggcuucuucagcagg

SEQ ID NO: 19959 - RNA, 18 nt, artificial
  Chemically synthesized
cuucuccugugaaaggcu

SEQ ID NO: 19960 - RNA, 18 nt, artificial
  Chemically synthesized
guuugugucuuuaauggc

SEQ ID NO: 19961 - RNA, 18 nt, artificial
  Chemically synthesized
cuucacuccaauuuccgg

SEQ ID NO: 19962 - RNA, 18 nt, artificial
  Chemically synthesized
aucauugaucaguaccac

SEQ ID NO: 19963 - RNA, 18 nt, artificial
  Chemically synthesized
uuucucuuugguggaucu

SEQ ID NO: 19964 - RNA, 18 nt, artificial
  Chemically synthesized
uucuccugugaaaggcug

SEQ ID NO: 19965 - RNA, 18 nt, artificial
  Chemically synthesized
ucucuucacuugcucccu

SEQ ID NO: 19966 - RNA, 18 nt, artificial
  Chemically synthesized
gacguaguacaugaaucg

SEQ ID NO: 19967 - RNA, 18 nt, artificial
  Chemically synthesized
gaugucacagcauccaug

SEQ ID NO: 19968 - RNA, 18 nt, artificial
  Chemically synthesized
auggaagccugaugggug

SEQ ID NO: 19969 - RNA, 18 nt, artificial
  Chemically synthesized
cauuugugggaauccgag

SEQ ID NO: 19970 - RNA, 18 nt, artificial
  Chemically synthesized
gagggaggucgaugaugc

SEQ ID NO: 19971 - RNA, 18 nt, artificial
  Chemically synthesized
auagggagaagugagagg

SEQ ID NO: 19972 - RNA, 18 nt, artificial
  Chemically synthesized
ccaccuccaauuucuggc

SEQ ID NO: 19973 - RNA, 18 nt, artificial
  Chemically synthesized
ucugguacuugcaccagg

SEQ ID NO: 19974 - RNA, 18 nt, artificial
  Chemically synthesized
acaagugucaacugagug

SEQ ID NO: 19975 - RNA, 18 nt, artificial
  Chemically synthesized
gauucuuguugcuuucuc

SEQ ID NO: 19976 - RNA, 18 nt, artificial
  Chemically synthesized
gacuuccuauguaaggcc

SEQ ID NO: 19977 - RNA, 18 nt, artificial
  Chemically synthesized
ugaaucggagcucaggug

SEQ ID NO: 19978 - RNA, 18 nt, artificial
  Chemically synthesized
uguucucugcuccaccug

SEQ ID NO: 19979 - RNA, 18 nt, artificial
  Chemically synthesized
ugggcuugugaucucagg

SEQ ID NO: 19980 - RNA, 18 nt, artificial
  Chemically synthesized
ggucuuccucacuguggc

SEQ ID NO: 19981 - RNA, 18 nt, artificial
  Chemically synthesized
caaucuaggcuucuugcu

SEQ ID NO: 19982 - RNA, 18 nt, artificial
  Chemically synthesized
uucuucccaguccaaagg

SEQ ID NO: 19983 - RNA, 18 nt, artificial
  Chemically synthesized
ugacugcaucuucccuac

SEQ ID NO: 19984 - RNA, 18 nt, artificial
  Chemically synthesized
ugcagugcugacugcauc

SEQ ID NO: 19985 - RNA, 18 nt, artificial
  Chemically synthesized
uagugacacuucuccugu

SEQ ID NO: 19986 - RNA, 18 nt, artificial
  Chemically synthesized
gaccauccauggugaggc

SEQ ID NO: 19987 - RNA, 18 nt, artificial
  Chemically synthesized
ugccuuccaaguaggaga

SEQ ID NO: 19988 - RNA, 18 nt, artificial
  Chemically synthesized
cuugcucccuccaccacc

SEQ ID NO: 19989 - RNA, 18 nt, artificial
  Chemically synthesized
uggguuuucuguuucuag

SEQ ID NO: 19990 - RNA, 18 nt, artificial
  Chemically synthesized
uuugaagugaaucgaugu

SEQ ID NO: 19991 - RNA, 18 nt, artificial
  Chemically synthesized
aggcuggcagagcaacug

SEQ ID NO: 19992 - RNA, 18 nt, artificial
  Chemically synthesized
auagucuuugcuccagcg

SEQ ID NO: 19993 - RNA, 18 nt, artificial
  Chemically synthesized
ugaucagucaggugaguc

SEQ ID NO: 19994 - RNA, 18 nt, artificial
  Chemically synthesized
guaguacaugaaucggag

SEQ ID NO: 19995 - RNA, 18 nt, artificial
  Chemically synthesized
agccuuaaguuucugugg

SEQ ID NO: 19996 - RNA, 18 nt, artificial
  Chemically synthesized
ggagacccagucuugacc

SEQ ID NO: 19997 - RNA, 18 nt, artificial
  Chemically synthesized
uuuagaaggacuuccuau

SEQ ID NO: 19998 - RNA, 18 nt, artificial
  Chemically synthesized
auccaugggcuugugauc

SEQ ID NO: 19999 - RNA, 18 nt, artificial
  Chemically synthesized
auggucuucuuagggagc

SEQ ID NO: 20000 - RNA, 18 nt, artificial
  Chemically synthesized
aggaauacagucaucugc

SEQ ID NO: 20001 - RNA, 18 nt, artificial
  Chemically synthesized
aagcucuccauggucuuc

SEQ ID NO: 20002 - RNA, 18 nt, artificial
  Chemically synthesized
ggcugugaagcaucgcug

SEQ ID NO: 20003 - RNA, 18 nt, artificial
  Chemically synthesized
aaacuuacugagaacaga

SEQ ID NO: 20004 - RNA, 18 nt, artificial
  Chemically synthesized
uuucagccuuaaguuucu

SEQ ID NO: 20005 - RNA, 18 nt, artificial
  Chemically synthesized
aaaaauacagugcagugc

SEQ ID NO: 20006 - RNA, 18 nt, artificial
  Chemically synthesized
gaugucucugggaagagg

SEQ ID NO: 20007 - RNA, 18 nt, artificial
  Chemically synthesized
gcugaggaacuguucucu

SEQ ID NO: 20008 - RNA, 18 nt, artificial
  Chemically synthesized
agugcugacugcaucuuc

SEQ ID NO: 20009 - RNA, 18 nt, artificial
  Chemically synthesized
aggaacuguucucugcuc

SEQ ID NO: 20010 - RNA, 18 nt, artificial
  Chemically synthesized
aggucuuccucacugugg

SEQ ID NO: 20011 - RNA, 18 nt, artificial
  Chemically synthesized
gcuucuugcugaucaguc

SEQ ID NO: 20012 - RNA, 18 nt, artificial
  Chemically synthesized
ugccugaaccagucagcc

SEQ ID NO: 20013 - RNA, 18 nt, artificial
  Chemically synthesized
aauacagucaucugccag

SEQ ID NO: 20014 - RNA, 18 nt, artificial
  Chemically synthesized
auugaacccugagcccug

SEQ ID NO: 20015 - RNA, 18 nt, artificial
  Chemically synthesized
aagccaccaucagggccc

SEQ ID NO: 20016 - RNA, 18 nt, artificial
  Chemically synthesized
cuuucucuuugguggauc

SEQ ID NO: 20017 - RNA, 18 nt, artificial
  Chemically synthesized
aucaguaccacuuccuac

SEQ ID NO: 20018 - RNA, 18 nt, artificial
  Chemically synthesized
ugacugagcugaggcuug

SEQ ID NO: 20019 - RNA, 18 nt, artificial
  Chemically synthesized
cuaggaagaccauccaug

SEQ ID NO: 20020 - RNA, 18 nt, artificial
  Chemically synthesized
uucccaucucuucacuug

SEQ ID NO: 20021 - RNA, 18 nt, artificial
  Chemically synthesized
uaguauucuagugacacu

SEQ ID NO: 20022 - RNA, 18 nt, artificial
  Chemically synthesized
aguugggccucuucuugg

SEQ ID NO: 20023 - RNA, 18 nt, artificial
  Chemically synthesized
ccaucauugaucaguacc

SEQ ID NO: 20024 - RNA, 18 nt, artificial
  Chemically synthesized
acauuugugggaauccga

SEQ ID NO: 20025 - RNA, 18 nt, artificial
  Chemically synthesized
gcgcugugacucacuccc

SEQ ID NO: 20026 - RNA, 18 nt, artificial
  Chemically synthesized
uacagugcagugcugacu

SEQ ID NO: 20027 - RNA, 18 nt, artificial
  Chemically synthesized
cgcaugacagcuucuuug

SEQ ID NO: 20028 - RNA, 18 nt, artificial
  Chemically synthesized
gcucuuugaagugaaucg

SEQ ID NO: 20029 - RNA, 18 nt, artificial
  Chemically synthesized
uacugcucagugccuggc

SEQ ID NO: 20030 - RNA, 18 nt, artificial
  Chemically synthesized
aacuguucucugcuccac

SEQ ID NO: 20031 - RNA, 18 nt, artificial
  Chemically synthesized
ugcucugaucccaggguc

SEQ ID NO: 20032 - RNA, 18 nt, artificial
  Chemically synthesized
aggagacccagucuugac

SEQ ID NO: 20033 - RNA, 18 nt, artificial
  Chemically synthesized
ugugaaggacuggauucu

SEQ ID NO: 20034 - RNA, 18 nt, artificial
  Chemically synthesized
augggcuugugaucucag

SEQ ID NO: 20035 - RNA, 18 nt, artificial
  Chemically synthesized
ucuuugguggaucugcgc

SEQ ID NO: 20036 - RNA, 18 nt, artificial
  Chemically synthesized
gugucaacugagugucug

SEQ ID NO: 20037 - RNA, 18 nt, artificial
  Chemically synthesized
accacugaugaagcuccc

SEQ ID NO: 20038 - RNA, 18 nt, artificial
  Chemically synthesized
auccgaggcccugcaugg

SEQ ID NO: 20039 - RNA, 18 nt, artificial
  Chemically synthesized
uaggaagaccauccaugg

SEQ ID NO: 20040 - RNA, 18 nt, artificial
  Chemically synthesized
aucgcuggaggugcuuuc

SEQ ID NO: 20041 - RNA, 18 nt, artificial
  Chemically synthesized
agaggaugucccugaugg

SEQ ID NO: 20042 - RNA, 18 nt, artificial
  Chemically synthesized
agaagugggugccaggcu

SEQ ID NO: 20043 - RNA, 18 nt, artificial
  Chemically synthesized
acaaacuuacugagaaca

SEQ ID NO: 20044 - RNA, 18 nt, artificial
  Chemically synthesized
aaucgaugucucugggaa

SEQ ID NO: 20045 - RNA, 18 nt, artificial
  Chemically synthesized
aacuuacugagaacagau

SEQ ID NO: 20046 - RNA, 18 nt, artificial
  Chemically synthesized
cacugaugaagcucccag

SEQ ID NO: 20047 - RNA, 18 nt, artificial
  Chemically synthesized
uggguggcaggcugggag

SEQ ID NO: 20048 - RNA, 18 nt, artificial
  Chemically synthesized
ucauugaucaguaccacu

SEQ ID NO: 20049 - RNA, 18 nt, artificial
  Chemically synthesized
agccaucuugccuagagg

SEQ ID NO: 20050 - RNA, 18 nt, artificial
  Chemically synthesized
ucuugccuagaggcuucu

SEQ ID NO: 20051 - RNA, 18 nt, artificial
  Chemically synthesized
ucacauuugugggaaucc

SEQ ID NO: 20052 - RNA, 18 nt, artificial
  Chemically synthesized
ugccaucgacguaguaca

SEQ ID NO: 20053 - RNA, 18 nt, artificial
  Chemically synthesized
uuugugucuuuaauggca

SEQ ID NO: 20054 - RNA, 18 nt, artificial
  Chemically synthesized
aggcauugaacccugagc

SEQ ID NO: 20055 - RNA, 18 nt, artificial
  Chemically synthesized
gagggaggagacccaguc

SEQ ID NO: 20056 - RNA, 18 nt, artificial
  Chemically synthesized
aggcaacuaggaagacca

SEQ ID NO: 20057 - RNA, 18 nt, artificial
  Chemically synthesized
aacagaguagugugagug

SEQ ID NO: 20058 - RNA, 18 nt, artificial
  Chemically synthesized
ugggugcucugaucccag

SEQ ID NO: 20059 - RNA, 18 nt, artificial
  Chemically synthesized
ugggagacgugacugagc

SEQ ID NO: 20060 - RNA, 18 nt, artificial
  Chemically synthesized
gugccaggcuuccugucc

SEQ ID NO: 20061 - RNA, 18 nt, artificial
  Chemically synthesized
cucccuauaccucuuguc

SEQ ID NO: 20062 - RNA, 18 nt, artificial
  Chemically synthesized
aguaauggaagccugaug

SEQ ID NO: 20063 - RNA, 18 nt, artificial
  Chemically synthesized
uucuuagggagcccacag

SEQ ID NO: 20064 - RNA, 18 nt, artificial
  Chemically synthesized
uguggagcagagccugug

SEQ ID NO: 20065 - RNA, 18 nt, artificial
  Chemically synthesized
aauccgaggcccugcaug

SEQ ID NO: 20066 - RNA, 18 nt, artificial
  Chemically synthesized
ucugccagaagaaaaaug

SEQ ID NO: 20067 - RNA, 18 nt, artificial
  Chemically synthesized
cuucuagguuugugucuu

SEQ ID NO: 20068 - RNA, 18 nt, artificial
  Chemically synthesized
accagucagccaucuugc

SEQ ID NO: 20069 - RNA, 18 nt, artificial
  Chemically synthesized
cagcucggacacuauagc

SEQ ID NO: 20070 - RNA, 18 nt, artificial
  Chemically synthesized
uccaugggcuugugaucu

SEQ ID NO: 20071 - RNA, 18 nt, artificial
  Chemically synthesized
gcucggacacuauagcgc

SEQ ID NO: 20072 - RNA, 18 nt, artificial
  Chemically synthesized
acuuacugagaacagaug

SEQ ID NO: 20073 - RNA, 18 nt, artificial
  Chemically synthesized
augaaucggagcucaggu

SEQ ID NO: 20074 - RNA, 18 nt, artificial
  Chemically synthesized
uugcugaucagucaggug

SEQ ID NO: 20075 - RNA, 18 nt, artificial
  Chemically synthesized
aggcugggagacgugacu

SEQ ID NO: 20076 - RNA, 18 nt, artificial
  Chemically synthesized
agcucuuugaagugaauc

SEQ ID NO: 20077 - RNA, 18 nt, artificial
  Chemically synthesized
aucagucaggugagucac

SEQ ID NO: 20078 - RNA, 18 nt, artificial
  Chemically synthesized
caaacuuacugagaacag

SEQ ID NO: 20079 - RNA, 18 nt, artificial
  Chemically synthesized
agggcugcuuucucuuug

SEQ ID NO: 20080 - RNA, 18 nt, artificial
  Chemically synthesized
gaagaaaaauggugauuc

SEQ ID NO: 20081 - RNA, 18 nt, artificial
  Chemically synthesized
gagcugggagggaggucg

SEQ ID NO: 20082 - RNA, 18 nt, artificial
  Chemically synthesized
cccauauucagaauggcc

SEQ ID NO: 20083 - RNA, 18 nt, artificial
  Chemically synthesized
cagcuucuuugacuugac

SEQ ID NO: 20084 - RNA, 18 nt, artificial
  Chemically synthesized
cuaccaccuccaauuucu

SEQ ID NO: 20085 - RNA, 18 nt, artificial
  Chemically synthesized
uuucuagcuucacuccaa

SEQ ID NO: 20086 - RNA, 18 nt, artificial
  Chemically synthesized
agcgcugugacucacucc

SEQ ID NO: 20087 - RNA, 18 nt, artificial
  Chemically synthesized
aaaauacagugcagugcu

SEQ ID NO: 20088 - RNA, 18 nt, artificial
  Chemically synthesized
uuccaaguaggagaccag

SEQ ID NO: 20089 - RNA, 18 nt, artificial
  Chemically synthesized
aagccugaugggugcucu

SEQ ID NO: 20090 - RNA, 18 nt, artificial
  Chemically synthesized
uugugaucucaggugaag

SEQ ID NO: 20091 - RNA, 18 nt, artificial
  Chemically synthesized
ggucgaugaugccauagc

SEQ ID NO: 20092 - RNA, 18 nt, artificial
  Chemically synthesized
uggugauucuucccaguc

SEQ ID NO: 20093 - RNA, 18 nt, artificial
  Chemically synthesized
guagugugagugugaagg

SEQ ID NO: 20094 - RNA, 18 nt, artificial
  Chemically synthesized
uguccuauaaggaauaca

SEQ ID NO: 20095 - RNA, 18 nt, artificial
  Chemically synthesized
auggugcagcccucggcc

SEQ ID NO: 20096 - RNA, 18 nt, artificial
  Chemically synthesized
gauggugcagcccucggc

SEQ ID NO: 20097 - RNA, 18 nt, artificial
  Chemically synthesized
cuuccuguccaguuaggc

SEQ ID NO: 20098 - RNA, 18 nt, artificial
  Chemically synthesized
aaaccuugccuguccuau

SEQ ID NO: 20099 - RNA, 18 nt, artificial
  Chemically synthesized
ccagaugucacagcaucc

SEQ ID NO: 20100 - RNA, 18 nt, artificial
  Chemically synthesized
ugggugccaggcuuccug

SEQ ID NO: 20101 - RNA, 18 nt, artificial
  Chemically synthesized
gaaaaauggugauucuuc

SEQ ID NO: 20102 - RNA, 18 nt, artificial
  Chemically synthesized
aguccaaaggugaagaug

SEQ ID NO: 20103 - RNA, 18 nt, artificial
  Chemically synthesized
agaggaacagaguagugu

SEQ ID NO: 20104 - RNA, 18 nt, artificial
  Chemically synthesized
ggacuuccuauguaaggc

SEQ ID NO: 20105 - RNA, 18 nt, artificial
  Chemically synthesized
cgaaagccaccaucaggg

SEQ ID NO: 20106 - RNA, 18 nt, artificial
  Chemically synthesized
uucuuuaggagggauacc

SEQ ID NO: 20107 - RNA, 18 nt, artificial
  Chemically synthesized
uggugacugugaaaguau

SEQ ID NO: 20108 - RNA, 18 nt, artificial
  Chemically synthesized
aacagaugaaugaaaccu

SEQ ID NO: 20109 - RNA, 18 nt, artificial
  Chemically synthesized
uugcaggaagcagcgcag

SEQ ID NO: 20110 - RNA, 18 nt, artificial
  Chemically synthesized
ucuaggcuucuagguuug

SEQ ID NO: 20111 - RNA, 18 nt, artificial
  Chemically synthesized
ugaaggcauugaacccug

SEQ ID NO: 20112 - RNA, 18 nt, artificial
  Chemically synthesized
caucuucccuacagcucu

SEQ ID NO: 20113 - RNA, 18 nt, artificial
  Chemically synthesized
cucacucccuauaccucu

SEQ ID NO: 20114 - RNA, 18 nt, artificial
  Chemically synthesized
uaguacaugaaucggagc

SEQ ID NO: 20115 - RNA, 18 nt, artificial
  Chemically synthesized
acugcaucuucccuacag

SEQ ID NO: 20116 - RNA, 18 nt, artificial
  Chemically synthesized
ugcugccuuccaaguagg

SEQ ID NO: 20117 - RNA, 18 nt, artificial
  Chemically synthesized
gucgaugaugccauagcg

SEQ ID NO: 20118 - RNA, 18 nt, artificial
  Chemically synthesized
auuucuggcuuccucaug

SEQ ID NO: 20119 - RNA, 18 nt, artificial
  Chemically synthesized
uguccugugagguaggcu

SEQ ID NO: 20120 - RNA, 18 nt, artificial
  Chemically synthesized
acagcucggacacuauag

SEQ ID NO: 20121 - RNA, 18 nt, artificial
  Chemically synthesized
acuacugcucagugccug

SEQ ID NO: 20122 - RNA, 18 nt, artificial
  Chemically synthesized
acagaugaaugaaaccuu

SEQ ID NO: 20123 - RNA, 18 nt, artificial
  Chemically synthesized
uucagaauggccucuagg

SEQ ID NO: 20124 - RNA, 18 nt, artificial
  Chemically synthesized
auugaucaguaccacuuc

SEQ ID NO: 20125 - RNA, 18 nt, artificial
  Chemically synthesized
cugucacucgcaugugug

SEQ ID NO: 20126 - RNA, 18 nt, artificial
  Chemically synthesized
cugacugcaucuucccua

SEQ ID NO: 20127 - RNA, 18 nt, artificial
  Chemically synthesized
cuccaauuucuggcuucc

SEQ ID NO: 20128 - RNA, 18 nt, artificial
  Chemically synthesized
cugggagacgugacugag

SEQ ID NO: 20129 - RNA, 18 nt, artificial
  Chemically synthesized
agccaucaggguaugagc

SEQ ID NO: 20130 - RNA, 18 nt, artificial
  Chemically synthesized
cacauuggaggaaauaau

SEQ ID NO: 20131 - RNA, 18 nt, artificial
  Chemically synthesized
guauucuagugacacuuc

SEQ ID NO: 20132 - RNA, 18 nt, artificial
  Chemically synthesized
ggaggagggaggagaccc

SEQ ID NO: 20133 - RNA, 18 nt, artificial
  Chemically synthesized
ugugaagcaucgcuggag

SEQ ID NO: 20134 - RNA, 18 nt, artificial
  Chemically synthesized
cccauuccaggguuuccc

SEQ ID NO: 20135 - RNA, 18 nt, artificial
  Chemically synthesized
gguccugaaggaagcccg

SEQ ID NO: 20136 - RNA, 18 nt, artificial
  Chemically synthesized
caacuggcacagggcugc

SEQ ID NO: 20137 - RNA, 18 nt, artificial
  Chemically synthesized
agaugucacagcauccau

SEQ ID NO: 20138 - RNA, 18 nt, artificial
  Chemically synthesized
acuauagcgccgccuggg

SEQ ID NO: 20139 - RNA, 18 nt, artificial
  Chemically synthesized
uucuugcugaucagucag

SEQ ID NO: 20140 - RNA, 18 nt, artificial
  Chemically synthesized
uaauggaagccugauggg

SEQ ID NO: 20141 - RNA, 18 nt, artificial
  Chemically synthesized
uugccuguccuauaagga

SEQ ID NO: 20142 - RNA, 18 nt, artificial
  Chemically synthesized
agugucugcagauaacgc

SEQ ID NO: 20143 - RNA, 18 nt, artificial
  Chemically synthesized
uggagcagagccuguggg

SEQ ID NO: 20144 - RNA, 18 nt, artificial
  Chemically synthesized
acgcagacgucauagucu

SEQ ID NO: 20145 - RNA, 18 nt, artificial
  Chemically synthesized
caauuucuggcuuccuca

SEQ ID NO: 20146 - RNA, 18 nt, artificial
  Chemically synthesized
accaggucuuccucacug

SEQ ID NO: 20147 - RNA, 18 nt, artificial
  Chemically synthesized
gcuggaggugcuuucugg

SEQ ID NO: 20148 - RNA, 18 nt, artificial
  Chemically synthesized
cagcgacuacugccacug

SEQ ID NO: 20149 - RNA, 18 nt, artificial
  Chemically synthesized
aucuaggcuucuugcuga

SEQ ID NO: 20150 - RNA, 18 nt, artificial
  Chemically synthesized
aggccugcaaucuaggcu

SEQ ID NO: 20151 - RNA, 18 nt, artificial
  Chemically synthesized
ucuuugaagugaaucgau

SEQ ID NO: 20152 - RNA, 18 nt, artificial
  Chemically synthesized
ccacuuccuaccaccucc

SEQ ID NO: 20153 - RNA, 18 nt, artificial
  Chemically synthesized
aacaaacuuacugagaac

SEQ ID NO: 20154 - RNA, 18 nt, artificial
  Chemically synthesized
gagacccagucuugaccu

SEQ ID NO: 20155 - RNA, 18 nt, artificial
  Chemically synthesized
ggcuucuagguuuguguc

SEQ ID NO: 20156 - RNA, 18 nt, artificial
  Chemically synthesized
uugggccucuucuugggc

SEQ ID NO: 20157 - RNA, 18 nt, artificial
  Chemically synthesized
agacccagucuugaccuc

SEQ ID NO: 20158 - RNA, 18 nt, artificial
  Chemically synthesized
ucuucuuagggagcccac

SEQ ID NO: 20159 - RNA, 18 nt, artificial
  Chemically synthesized
cacagggcugcuuucucu

SEQ ID NO: 20160 - RNA, 18 nt, artificial
  Chemically synthesized
gucaggugagucacuucu

SEQ ID NO: 20161 - RNA, 18 nt, artificial
  Chemically synthesized
caaguaggagaccagguc

SEQ ID NO: 20162 - RNA, 18 nt, artificial
  Chemically synthesized
gagccaggagcugggagg

SEQ ID NO: 20163 - RNA, 18 nt, artificial
  Chemically synthesized
gguuugugucuuuaaugg

SEQ ID NO: 20164 - RNA, 18 nt, artificial
  Chemically synthesized
ggcugggagacgugacug

SEQ ID NO: 20165 - RNA, 18 nt, artificial
  Chemically synthesized
ucaugauagggagaagug

SEQ ID NO: 20166 - RNA, 18 nt, artificial
  Chemically synthesized
agcucagcaugaccagcu

SEQ ID NO: 20167 - RNA, 18 nt, artificial
  Chemically synthesized
uaccaccuccaauuucug

SEQ ID NO: 20168 - RNA, 18 nt, artificial
  Chemically synthesized
agcccuggauucccaucu

SEQ ID NO: 20169 - RNA, 18 nt, artificial
  Chemically synthesized
cagccaucaggguaugag

SEQ ID NO: 20170 - RNA, 18 nt, artificial
  Chemically synthesized
gguaggcugugaagcauc

SEQ ID NO: 20171 - RNA, 18 nt, artificial
  Chemically synthesized
agcaaagcgcugugacuc

SEQ ID NO: 20172 - RNA, 18 nt, artificial
  Chemically synthesized
agaugaguccugcuggcc

SEQ ID NO: 20173 - RNA, 18 nt, artificial
  Chemically synthesized
cagaugaaugaaaccuug

SEQ ID NO: 20174 - RNA, 18 nt, artificial
  Chemically synthesized
cuuaaguuucuguggagc

SEQ ID NO: 20175 - RNA, 18 nt, artificial
  Chemically synthesized
ucgaugaugccauagcgu

SEQ ID NO: 20176 - RNA, 18 nt, artificial
  Chemically synthesized
ucagcaugaccagcugag

SEQ ID NO: 20177 - RNA, 18 nt, artificial
  Chemically synthesized
gugacuacugcucagugc

SEQ ID NO: 20178 - RNA, 18 nt, artificial
  Chemically synthesized
aagcgcugugacucacuc

SEQ ID NO: 20179 - RNA, 18 nt, artificial
  Chemically synthesized
gcuucuucagcagggucu

SEQ ID NO: 20180 - RNA, 18 nt, artificial
  Chemically synthesized
agcucggacacuauagcg

SEQ ID NO: 20181 - RNA, 18 nt, artificial
  Chemically synthesized
gagcaacuggcacagggc

SEQ ID NO: 20182 - RNA, 18 nt, artificial
  Chemically synthesized
agggcugcgcggacugcg

SEQ ID NO: 20183 - RNA, 18 nt, artificial
  Chemically synthesized
cucccagaugucacagca

SEQ ID NO: 20184 - RNA, 18 nt, artificial
  Chemically synthesized
cauugaacccugagcccu

SEQ ID NO: 20185 - RNA, 18 nt, artificial
  Chemically synthesized
ggcuugugaucucaggug

SEQ ID NO: 20186 - RNA, 18 nt, artificial
  Chemically synthesized
guugcaucccggaguugc

SEQ ID NO: 20187 - RNA, 18 nt, artificial
  Chemically synthesized
ugcuggccaucauugauc

SEQ ID NO: 20188 - RNA, 18 nt, artificial
  Chemically synthesized
agauaacgcaugacagcu

SEQ ID NO: 20189 - RNA, 18 nt, artificial
  Chemically synthesized
aaucggagcucagguggg

SEQ ID NO: 20190 - RNA, 18 nt, artificial
  Chemically synthesized
ucuuuaauggcaccuagg

SEQ ID NO: 20191 - RNA, 18 nt, artificial
  Chemically synthesized
caggcugggagacgugac

SEQ ID NO: 20192 - RNA, 18 nt, artificial
  Chemically synthesized
acuguggcacacgcagac

SEQ ID NO: 20193 - RNA, 18 nt, artificial
  Chemically synthesized
cagacgucauagucuuug

SEQ ID NO: 20194 - RNA, 18 nt, artificial
  Chemically synthesized
gaugaugccauagcgugg

SEQ ID NO: 20195 - RNA, 18 nt, artificial
  Chemically synthesized
guugcaggaagcagcgca

SEQ ID NO: 20196 - RNA, 18 nt, artificial
  Chemically synthesized
gcugcuuucucuuuggug

SEQ ID NO: 20197 - RNA, 18 nt, artificial
  Chemically synthesized
cuauaaggaauacaguca

SEQ ID NO: 20198 - RNA, 18 nt, artificial
  Chemically synthesized
cagcugaggaacuguucu

SEQ ID NO: 20199 - RNA, 18 nt, artificial
  Chemically synthesized
ucuuccucacuguggcac

SEQ ID NO: 20200 - RNA, 18 nt, artificial
  Chemically synthesized
gaacagaugaaugaaacc

SEQ ID NO: 20201 - RNA, 18 nt, artificial
  Chemically synthesized
caguugcgaugagggcug

SEQ ID NO: 20202 - RNA, 18 nt, artificial
  Chemically synthesized
caucauugaucaguacca

SEQ ID NO: 20203 - RNA, 18 nt, artificial
  Chemically synthesized
augggugcucugauccca

SEQ ID NO: 20204 - RNA, 18 nt, artificial
  Chemically synthesized
uaccucuugucacauuug

SEQ ID NO: 20205 - RNA, 18 nt, artificial
  Chemically synthesized
cuguucucugcuccaccu

SEQ ID NO: 20206 - RNA, 18 nt, artificial
  Chemically synthesized
uauaacaagugucaacug

SEQ ID NO: 20207 - RNA, 18 nt, artificial
  Chemically synthesized
gaacuguucucugcucca

SEQ ID NO: 20208 - RNA, 18 nt, artificial
  Chemically synthesized
cauccaugggcuugugau

SEQ ID NO: 20209 - RNA, 18 nt, artificial
  Chemically synthesized
uucccuacagcucuuuga

SEQ ID NO: 20210 - RNA, 18 nt, artificial
  Chemically synthesized
acacuauagcgccgccug

SEQ ID NO: 20211 - RNA, 18 nt, artificial
  Chemically synthesized
gcagggucugccugaacc

SEQ ID NO: 20212 - RNA, 18 nt, artificial
  Chemically synthesized
cugcaucuucccuacagc

SEQ ID NO: 20213 - RNA, 18 nt, artificial
  Chemically synthesized
caugauauaacaaguguc

SEQ ID NO: 20214 - RNA, 18 nt, artificial
  Chemically synthesized
uggauucccaucucuuca

SEQ ID NO: 20215 - RNA, 18 nt, artificial
  Chemically synthesized
cuggaggugcuuucuggg

SEQ ID NO: 20216 - RNA, 18 nt, artificial
  Chemically synthesized
uggauucuuguugcuuuc

SEQ ID NO: 20217 - RNA, 18 nt, artificial
  Chemically synthesized
ccaagcucuccauggucu

SEQ ID NO: 20218 - RNA, 18 nt, artificial
  Chemically synthesized
uugaacccugagcccugg

SEQ ID NO: 20219 - RNA, 18 nt, artificial
  Chemically synthesized
gcauugaacccugagccc

SEQ ID NO: 20220 - RNA, 18 nt, artificial
  Chemically synthesized
agaccagguccugggcgg

SEQ ID NO: 20221 - RNA, 18 nt, artificial
  Chemically synthesized
agcccacaguaauggaag

SEQ ID NO: 20222 - RNA, 18 nt, artificial
  Chemically synthesized
agucaggugagucacuuc

SEQ ID NO: 20223 - RNA, 18 nt, artificial
  Chemically synthesized
acaacaaacuuacugaga

SEQ ID NO: 20224 - RNA, 18 nt, artificial
  Chemically synthesized
cucuuucagccuuaaguu

SEQ ID NO: 20225 - RNA, 18 nt, artificial
  Chemically synthesized
acguaguacaugaaucgg

SEQ ID NO: 20226 - RNA, 18 nt, artificial
  Chemically synthesized
auucccaucucuucacuu

SEQ ID NO: 20227 - RNA, 18 nt, artificial
  Chemically synthesized
cuccagcgacuacugcca

SEQ ID NO: 20228 - RNA, 18 nt, artificial
  Chemically synthesized
ccauauucagaauggccu

SEQ ID NO: 20229 - RNA, 18 nt, artificial
  Chemically synthesized
aggcagcucuuuagaagg

SEQ ID NO: 20230 - RNA, 18 nt, artificial
  Chemically synthesized
cugccacugucacucgca

SEQ ID NO: 20231 - RNA, 18 nt, artificial
  Chemically synthesized
acccggcagugacuacug

SEQ ID NO: 20232 - RNA, 18 nt, artificial
  Chemically synthesized
gacgucauagucuuugcu

SEQ ID NO: 20233 - RNA, 18 nt, artificial
  Chemically synthesized
uuugacuugacgaaagcc

SEQ ID NO: 20234 - RNA, 18 nt, artificial
  Chemically synthesized
gcuucuagguuugugucu

SEQ ID NO: 20235 - RNA, 18 nt, artificial
  Chemically synthesized
aagcucccagaugucaca

SEQ ID NO: 20236 - RNA, 18 nt, artificial
  Chemically synthesized
aggauauucgggaucugg

SEQ ID NO: 20237 - RNA, 18 nt, artificial
  Chemically synthesized
aaagcgcugugacucacu

SEQ ID NO: 20238 - RNA, 18 nt, artificial
  Chemically synthesized
cucuuugaagugaaucga

SEQ ID NO: 20239 - RNA, 18 nt, artificial
  Chemically synthesized
gucuucuuagggagccca

SEQ ID NO: 20240 - RNA, 18 nt, artificial
  Chemically synthesized
gugugaaggacuggauuc

SEQ ID NO: 20241 - RNA, 18 nt, artificial
  Chemically synthesized
acuacugccacugucacu

SEQ ID NO: 20242 - RNA, 18 nt, artificial
  Chemically synthesized
ugcaucuucccuacagcu

SEQ ID NO: 20243 - RNA, 18 nt, artificial
  Chemically synthesized
ugaagauggugacuguga

SEQ ID NO: 20244 - RNA, 18 nt, artificial
  Chemically synthesized
gugaagauggugacugug

SEQ ID NO: 20245 - RNA, 18 nt, artificial
  Chemically synthesized
agcuucuuugacuugacg

SEQ ID NO: 20246 - RNA, 18 nt, artificial
  Chemically synthesized
caucuugccuagaggcuu

SEQ ID NO: 20247 - RNA, 18 nt, artificial
  Chemically synthesized
aaggacuuccuauguaag

SEQ ID NO: 20248 - RNA, 18 nt, artificial
  Chemically synthesized
aagugggugccaggcuuc

SEQ ID NO: 20249 - RNA, 18 nt, artificial
  Chemically synthesized
uuaaguuucuguggagca

SEQ ID NO: 20250 - RNA, 18 nt, artificial
  Chemically synthesized
acugagcugaggcuuggg

SEQ ID NO: 20251 - RNA, 18 nt, artificial
  Chemically synthesized
cguaguacaugaaucgga

SEQ ID NO: 20252 - RNA, 18 nt, artificial
  Chemically synthesized
caguguacgccagugccc

SEQ ID NO: 20253 - RNA, 18 nt, artificial
  Chemically synthesized
caggcaacuaggaagacc

SEQ ID NO: 20254 - RNA, 18 nt, artificial
  Chemically synthesized
guuucuguggagcagagc

SEQ ID NO: 20255 - RNA, 18 nt, artificial
  Chemically synthesized
cuucuugcugaucaguca

SEQ ID NO: 20256 - RNA, 18 nt, artificial
  Chemically synthesized
guacaugaaucggagcuc

SEQ ID NO: 20257 - RNA, 18 nt, artificial
  Chemically synthesized
aagcccggcgugaugagc

SEQ ID NO: 20258 - RNA, 18 nt, artificial
  Chemically synthesized
ucugccugaaccagucag

SEQ ID NO: 20259 - RNA, 18 nt, artificial
  Chemically synthesized
ggcuguaguauucuagug

SEQ ID NO: 20260 - RNA, 18 nt, artificial
  Chemically synthesized
cuguaguauucuagugac

SEQ ID NO: 20261 - RNA, 18 nt, artificial
  Chemically synthesized
aggacuuccuauguaagg

SEQ ID NO: 20262 - RNA, 18 nt, artificial
  Chemically synthesized
gugcugccuuccaaguag

SEQ ID NO: 20263 - RNA, 18 nt, artificial
  Chemically synthesized
gugugagugugaaggacu

SEQ ID NO: 20264 - RNA, 18 nt, artificial
  Chemically synthesized
cuucuucagcagggucug

SEQ ID NO: 20265 - RNA, 18 nt, artificial
  Chemically synthesized
uuccuaccaccuccaauu

SEQ ID NO: 20266 - RNA, 18 nt, artificial
  Chemically synthesized
ccagcuucacggccuucc

SEQ ID NO: 20267 - RNA, 18 nt, artificial
  Chemically synthesized
cugccuuccaaguaggag

SEQ ID NO: 20268 - RNA, 18 nt, artificial
  Chemically synthesized
gcuggcagagcaacuggc

SEQ ID NO: 20269 - RNA, 18 nt, artificial
  Chemically synthesized
acucacucccuauaccuc

SEQ ID NO: 20270 - RNA, 18 nt, artificial
  Chemically synthesized
ugaugaagcucccagaug

SEQ ID NO: 20271 - RNA, 18 nt, artificial
  Chemically synthesized
cugaugggugcucugauc

SEQ ID NO: 20272 - RNA, 18 nt, artificial
  Chemically synthesized
ucugaucccagggucacg

SEQ ID NO: 20273 - RNA, 18 nt, artificial
  Chemically synthesized
ugacagcuucuuugacuu

SEQ ID NO: 20274 - RNA, 18 nt, artificial
  Chemically synthesized
agaauggccucuaggcuu

SEQ ID NO: 20275 - RNA, 18 nt, artificial
  Chemically synthesized
cuuccucauggcuuuccu

SEQ ID NO: 20276 - RNA, 18 nt, artificial
  Chemically synthesized
gugagucacuucuuuagg

SEQ ID NO: 20277 - RNA, 18 nt, artificial
  Chemically synthesized
aucaggguaugagcucag

SEQ ID NO: 20278 - RNA, 18 nt, artificial
  Chemically synthesized
ccaucucuucacuugcuc

SEQ ID NO: 20279 - RNA, 18 nt, artificial
  Chemically synthesized
gugucugcagauaacgca

SEQ ID NO: 20280 - RNA, 18 nt, artificial
  Chemically synthesized
aaggcuggcagagcaacu

SEQ ID NO: 20281 - RNA, 18 nt, artificial
  Chemically synthesized
gguuuucuguuucuagcu

SEQ ID NO: 20282 - RNA, 18 nt, artificial
  Chemically synthesized
caccuccaauuucuggcu

SEQ ID NO: 20283 - RNA, 18 nt, artificial
  Chemically synthesized
ucugcuccaccuggccag

SEQ ID NO: 20284 - RNA, 18 nt, artificial
  Chemically synthesized
ggucugccugaaccaguc

SEQ ID NO: 20285 - RNA, 18 nt, artificial
  Chemically synthesized
ugaaaccuugccuguccu

SEQ ID NO: 20286 - RNA, 18 nt, artificial
  Chemically synthesized
aaaguacacauuggagga

SEQ ID NO: 20287 - RNA, 18 nt, artificial
  Chemically synthesized
agggaggucgaugaugcc

SEQ ID NO: 20288 - RNA, 18 nt, artificial
  Chemically synthesized
ucacuguggcacacgcag

SEQ ID NO: 20289 - RNA, 18 nt, artificial
  Chemically synthesized
agggauaccaguguacgc

SEQ ID NO: 20290 - RNA, 18 nt, artificial
  Chemically synthesized
ggugaaggcauugaaccc

SEQ ID NO: 20291 - RNA, 18 nt, artificial
  Chemically synthesized
uacaugaaucggagcuca

SEQ ID NO: 20292 - RNA, 18 nt, artificial
  Chemically synthesized
gccaucuugccuagaggc

SEQ ID NO: 20293 - RNA, 18 nt, artificial
  Chemically synthesized
gcucccagaugucacagc

SEQ ID NO: 20294 - RNA, 18 nt, artificial
  Chemically synthesized
uguguggguggcaggcug

SEQ ID NO: 20295 - RNA, 18 nt, artificial
  Chemically synthesized
agugucaacugagugucu

SEQ ID NO: 20296 - RNA, 18 nt, artificial
  Chemically synthesized
cacuucuccugugaaagg

SEQ ID NO: 20297 - RNA, 18 nt, artificial
  Chemically synthesized
ucuugaccucauggagca

SEQ ID NO: 20298 - RNA, 18 nt, artificial
  Chemically synthesized
uuaggcaggagaugaguc

SEQ ID NO: 20299 - RNA, 18 nt, artificial
  Chemically synthesized
acugaugaagcucccaga

SEQ ID NO: 20300 - RNA, 18 nt, artificial
  Chemically synthesized
ugagggcugcgcggacug

SEQ ID NO: 20301 - RNA, 18 nt, artificial
  Chemically synthesized
cagugcccaguuccaggg

SEQ ID NO: 20302 - RNA, 18 nt, artificial
  Chemically synthesized
ugaccagcugaggaacug

SEQ ID NO: 20303 - RNA, 18 nt, artificial
  Chemically synthesized
acuggauucuuguugcuu

SEQ ID NO: 20304 - RNA, 18 nt, artificial
  Chemically synthesized
auggugacugugaaagua

SEQ ID NO: 20305 - RNA, 18 nt, artificial
  Chemically synthesized
ccggcagugacuacugcu

SEQ ID NO: 20306 - RNA, 18 nt, artificial
  Chemically synthesized
gccagaccacugaugaag

SEQ ID NO: 20307 - RNA, 18 nt, artificial
  Chemically synthesized
gugaugagcagcacccgg

SEQ ID NO: 20308 - RNA, 18 nt, artificial
  Chemically synthesized
aaccagucagccaucuug

SEQ ID NO: 20309 - RNA, 18 nt, artificial
  Chemically synthesized
caggcuggcagugcugcc

SEQ ID NO: 20310 - RNA, 18 nt, artificial
  Chemically synthesized
uguaguauucuagugaca

SEQ ID NO: 20311 - RNA, 18 nt, artificial
  Chemically synthesized
gcuucacggccuuccugg

SEQ ID NO: 20312 - RNA, 18 nt, artificial
  Chemically synthesized
caucgacguaguacauga

SEQ ID NO: 20313 - RNA, 18 nt, artificial
  Chemically synthesized
cuggauucccaucucuuc

SEQ ID NO: 20314 - RNA, 18 nt, artificial
  Chemically synthesized
ggcgugaugagcagcacc

SEQ ID NO: 20315 - RNA, 18 nt, artificial
  Chemically synthesized
ccaguguacgccagugcc

SEQ ID NO: 20316 - RNA, 18 nt, artificial
  Chemically synthesized
agugcagugcugacugca

SEQ ID NO: 20317 - RNA, 18 nt, artificial
  Chemically synthesized
gcagugcugccuuccaag

SEQ ID NO: 20318 - RNA, 18 nt, artificial
  Chemically synthesized
gucccaugauauaacaag

SEQ ID NO: 20319 - RNA, 18 nt, artificial
  Chemically synthesized
cacaguaauggaagccug

SEQ ID NO: 20320 - RNA, 18 nt, artificial
  Chemically synthesized
aaggcauugaacccugag

SEQ ID NO: 20321 - RNA, 18 nt, artificial
  Chemically synthesized
cucauggcuuuccuaggg

SEQ ID NO: 20322 - RNA, 18 nt, artificial
  Chemically synthesized
aaagccaccaucagggcc

SEQ ID NO: 20323 - RNA, 18 nt, artificial
  Chemically synthesized
gcgacuacugccacuguc

SEQ ID NO: 20324 - RNA, 18 nt, artificial
  Chemically synthesized
cccacaguaauggaagcc

SEQ ID NO: 20325 - RNA, 18 nt, artificial
  Chemically synthesized
ugaucucaggugaaggca

SEQ ID NO: 20326 - RNA, 18 nt, artificial
  Chemically synthesized
caucugguacuugcacca

SEQ ID NO: 20327 - RNA, 18 nt, artificial
  Chemically synthesized
uaccaguguacgccagug

SEQ ID NO: 20328 - RNA, 18 nt, artificial
  Chemically synthesized
gaguugggccucuucuug

SEQ ID NO: 20329 - RNA, 18 nt, artificial
  Chemically synthesized
gcacagggcugcuuucuc

SEQ ID NO: 20330 - RNA, 18 nt, artificial
  Chemically synthesized
agagccaggagcugggag

SEQ ID NO: 20331 - RNA, 18 nt, artificial
  Chemically synthesized
ugugagugugaaggacug

SEQ ID NO: 20332 - RNA, 18 nt, artificial
  Chemically synthesized
uucuucagcagggucugc

SEQ ID NO: 20333 - RNA, 18 nt, artificial
  Chemically synthesized
uggaagccugaugggugc

SEQ ID NO: 20334 - RNA, 18 nt, artificial
  Chemically synthesized
ugagugugaaggacugga

SEQ ID NO: 20335 - RNA, 18 nt, artificial
  Chemically synthesized
agucacuucuuuaggagg

SEQ ID NO: 20336 - RNA, 18 nt, artificial
  Chemically synthesized
augaagcucccagauguc

SEQ ID NO: 20337 - RNA, 18 nt, artificial
  Chemically synthesized
ggauauucgggaucuggg

SEQ ID NO: 20338 - RNA, 18 nt, artificial
  Chemically synthesized
gugauucuucccagucca

SEQ ID NO: 20339 - RNA, 18 nt, artificial
  Chemically synthesized
aaaggcuggcagagcaac

SEQ ID NO: 20340 - RNA, 18 nt, artificial
  Chemically synthesized
gauggugacugugaaagu

SEQ ID NO: 20341 - RNA, 18 nt, artificial
  Chemically synthesized
aaguaucagcuuuagcca

SEQ ID NO: 20342 - RNA, 18 nt, artificial
  Chemically synthesized
acccugagcccuggauuc

SEQ ID NO: 20343 - RNA, 18 nt, artificial
  Chemically synthesized
agaccauccauggugagg

SEQ ID NO: 20344 - RNA, 18 nt, artificial
  Chemically synthesized
aacugagugucugcagau

SEQ ID NO: 20345 - RNA, 18 nt, artificial
  Chemically synthesized
guagugggcuguccugug

SEQ ID NO: 20346 - RNA, 18 nt, artificial
  Chemically synthesized
gacacuauagcgccgccu

SEQ ID NO: 20347 - RNA, 18 nt, artificial
  Chemically synthesized
uucccaguccaaagguga

SEQ ID NO: 20348 - RNA, 18 nt, artificial
  Chemically synthesized
ccucuugucacauuugug

SEQ ID NO: 20349 - RNA, 18 nt, artificial
  Chemically synthesized
agugggugccaggcuucc

SEQ ID NO: 20350 - RNA, 18 nt, artificial
  Chemically synthesized
gucaugauagggagaagu

SEQ ID NO: 20351 - RNA, 18 nt, artificial
  Chemically synthesized
gaggaacagaguagugug

SEQ ID NO: 20352 - RNA, 18 nt, artificial
  Chemically synthesized
auaacgcaugacagcuuc

SEQ ID NO: 20353 - RNA, 18 nt, artificial
  Chemically synthesized
cuuacugagaacagauga

SEQ ID NO: 20354 - RNA, 18 nt, artificial
  Chemically synthesized
cucuaggcuucuagguuu

SEQ ID NO: 20355 - RNA, 18 nt, artificial
  Chemically synthesized
ucacucgcaugugugggu

SEQ ID NO: 20356 - RNA, 18 nt, artificial
  Chemically synthesized
auacagugcagugcugac

SEQ ID NO: 20357 - RNA, 18 nt, artificial
  Chemically synthesized
ccagaccacugaugaagc

SEQ ID NO: 20358 - RNA, 18 nt, artificial
  Chemically synthesized
auggugauucuucccagu

SEQ ID NO: 20359 - RNA, 18 nt, artificial
  Chemically synthesized
aauacagugcagugcuga

SEQ ID NO: 20360 - RNA, 18 nt, artificial
  Chemically synthesized
guaggcugugaagcaucg

SEQ ID NO: 20361 - RNA, 18 nt, artificial
  Chemically synthesized
ugggcuguccugugaggu

SEQ ID NO: 20362 - RNA, 18 nt, artificial
  Chemically synthesized
uucacuugcucccuccac

SEQ ID NO: 20363 - RNA, 18 nt, artificial
  Chemically synthesized
ccagugcccaguuccagg

SEQ ID NO: 20364 - RNA, 18 nt, artificial
  Chemically synthesized
gacccagucuugaccuca

SEQ ID NO: 20365 - RNA, 18 nt, artificial
  Chemically synthesized
cagcucuuuagaaggacu

SEQ ID NO: 20366 - RNA, 18 nt, artificial
  Chemically synthesized
gggcugcuuucucuuugg

SEQ ID NO: 20367 - RNA, 18 nt, artificial
  Chemically synthesized
uccuauaaggaauacagu

SEQ ID NO: 20368 - RNA, 18 nt, artificial
  Chemically synthesized
cauauucagaauggccuc

SEQ ID NO: 20369 - RNA, 18 nt, artificial
  Chemically synthesized
caugaaucggagcucagg

SEQ ID NO: 20370 - RNA, 18 nt, artificial
  Chemically synthesized
guugggccucuucuuggg

SEQ ID NO: 20371 - RNA, 18 nt, artificial
  Chemically synthesized
uggcagagcaacuggcac

SEQ ID NO: 20372 - RNA, 18 nt, artificial
  Chemically synthesized
uaggagaccagguccugg

SEQ ID NO: 20373 - RNA, 18 nt, artificial
  Chemically synthesized
gugaaggcauugaacccu

SEQ ID NO: 20374 - RNA, 18 nt, artificial
  Chemically synthesized
gacgugacugagcugagg

SEQ ID NO: 20375 - RNA, 18 nt, artificial
  Chemically synthesized
cgugacugagcugaggcu

SEQ ID NO: 20376 - RNA, 18 nt, artificial
  Chemically synthesized
ggcuucuucagcaggguc

SEQ ID NO: 20377 - RNA, 18 nt, artificial
  Chemically synthesized
gucuuugcuccagcgacu

SEQ ID NO: 20378 - RNA, 18 nt, artificial
  Chemically synthesized
uugcaucccggaguugca

SEQ ID NO: 20379 - RNA, 18 nt, artificial
  Chemically synthesized
ucgaugucucugggaaga

SEQ ID NO: 20380 - RNA, 18 nt, artificial
  Chemically synthesized
acagaagugggugccagg

SEQ ID NO: 20381 - RNA, 18 nt, artificial
  Chemically synthesized
cacugucacucgcaugug

SEQ ID NO: 20382 - RNA, 18 nt, artificial
  Chemically synthesized
ggaagaccauccauggug

SEQ ID NO: 20383 - RNA, 18 nt, artificial
  Chemically synthesized
cuggcagugcugccuucc

SEQ ID NO: 20384 - RNA, 18 nt, artificial
  Chemically synthesized
cuacugcucagugccugg

SEQ ID NO: 20385 - RNA, 18 nt, artificial
  Chemically synthesized
cacgcagacgucauaguc

SEQ ID NO: 20386 - RNA, 18 nt, artificial
  Chemically synthesized
auguguggguggcaggcu

SEQ ID NO: 20387 - RNA, 18 nt, artificial
  Chemically synthesized
aagaggaacagaguagug

SEQ ID NO: 20388 - RNA, 18 nt, artificial
  Chemically synthesized
caggaagcagcgcaggcu

SEQ ID NO: 20389 - RNA, 18 nt, artificial
  Chemically synthesized
uuuaggagggauaccagu

SEQ ID NO: 20390 - RNA, 18 nt, artificial
  Chemically synthesized
agcaucugguacuugcac

SEQ ID NO: 20391 - RNA, 18 nt, artificial
  Chemically synthesized
agugacuacugcucagug

SEQ ID NO: 20392 - RNA, 18 nt, artificial
  Chemically synthesized
gagacgugacugagcuga

SEQ ID NO: 20393 - RNA, 18 nt, artificial
  Chemically synthesized
uaccacuuccuaccaccu

SEQ ID NO: 20394 - RNA, 18 nt, artificial
  Chemically synthesized
uucagcagggucugccug

SEQ ID NO: 20395 - RNA, 18 nt, artificial
  Chemically synthesized
uccugaugcccauuccag

SEQ ID NO: 20396 - RNA, 18 nt, artificial
  Chemically synthesized
cuuccaaguaggagacca

SEQ ID NO: 20397 - RNA, 18 nt, artificial
  Chemically synthesized
acucgcaugugugggugg

SEQ ID NO: 20398 - RNA, 18 nt, artificial
  Chemically synthesized
uggcggacacucuuucag

SEQ ID NO: 20399 - RNA, 18 nt, artificial
  Chemically synthesized
gugacugugaaaguauca

SEQ ID NO: 20400 - RNA, 18 nt, artificial
  Chemically synthesized
caacaaacuuacugagaa

SEQ ID NO: 20401 - RNA, 18 nt, artificial
  Chemically synthesized
uccagcgacuacugccac

SEQ ID NO: 20402 - RNA, 18 nt, artificial
  Chemically synthesized
ucauagucuuugcuccag

SEQ ID NO: 20403 - RNA, 18 nt, artificial
  Chemically synthesized
auauucagaauggccucu

SEQ ID NO: 20404 - RNA, 18 nt, artificial
  Chemically synthesized
ccagcugaggaacuguuc

SEQ ID NO: 20405 - RNA, 18 nt, artificial
  Chemically synthesized
ccgagagccaggagcugg

SEQ ID NO: 20406 - RNA, 18 nt, artificial
  Chemically synthesized
cgacuacugccacuguca

SEQ ID NO: 20407 - RNA, 18 nt, artificial
  Chemically synthesized
uuccucauggccuucuug

SEQ ID NO: 20408 - RNA, 18 nt, artificial
  Chemically synthesized
gagggauaccaguguacg

SEQ ID NO: 20409 - RNA, 18 nt, artificial
  Chemically synthesized
acagggcugcuuucucuu

SEQ ID NO: 20410 - RNA, 18 nt, artificial
  Chemically synthesized
ccaucuugccuagaggcu

SEQ ID NO: 20411 - RNA, 18 nt, artificial
  Chemically synthesized
cugccaucgacguaguac

SEQ ID NO: 20412 - RNA, 18 nt, artificial
  Chemically synthesized
cuugccuguccuauaagg

SEQ ID NO: 20413 - RNA, 18 nt, artificial
  Chemically synthesized
cacccggcagugacuacu

SEQ ID NO: 20414 - RNA, 18 nt, artificial
  Chemically synthesized
cagucuugaccucaugga

SEQ ID NO: 20415 - RNA, 18 nt, artificial
  Chemically synthesized
caaaggugaagaugguga

SEQ ID NO: 20416 - RNA, 18 nt, artificial
  Chemically synthesized
aggagaugaguccugcug

SEQ ID NO: 20417 - RNA, 18 nt, artificial
  Chemically synthesized
gcuuccucauggcuuucc

SEQ ID NO: 20418 - RNA, 18 nt, artificial
  Chemically synthesized
gcuguaguauucuaguga

SEQ ID NO: 20419 - RNA, 18 nt, artificial
  Chemically synthesized
cagaugucacagcaucca

SEQ ID NO: 20420 - RNA, 18 nt, artificial
  Chemically synthesized
agguggguaggcagcucu

SEQ ID NO: 20421 - RNA, 18 nt, artificial
  Chemically synthesized
ggaggucgaugaugccau

SEQ ID NO: 20422 - RNA, 18 nt, artificial
  Chemically synthesized
gacuggauucuuguugcu

SEQ ID NO: 20423 - RNA, 18 nt, artificial
  Chemically synthesized
ucgcuggaggugcuuucu

SEQ ID NO: 20424 - RNA, 18 nt, artificial
  Chemically synthesized
ugucacucgcaugugugg

SEQ ID NO: 20425 - RNA, 18 nt, artificial
  Chemically synthesized
uuuaauggcaccuaggca

SEQ ID NO: 20426 - RNA, 18 nt, artificial
  Chemically synthesized
aggcuggcagugcugccu

SEQ ID NO: 20427 - RNA, 18 nt, artificial
  Chemically synthesized
ccaguugcgaugagggcu

SEQ ID NO: 20428 - RNA, 18 nt, artificial
  Chemically synthesized
cggcagugacuacugcuc

SEQ ID NO: 20429 - RNA, 18 nt, artificial
  Chemically synthesized
caggucuuccucacugug

SEQ ID NO: 20430 - RNA, 18 nt, artificial
  Chemically synthesized
gugacugagcugaggcuu

SEQ ID NO: 20431 - RNA, 18 nt, artificial
  Chemically synthesized
uuguugcuuucuccugau

SEQ ID NO: 20432 - RNA, 18 nt, artificial
  Chemically synthesized
uggagccucggucagggc

SEQ ID NO: 20433 - RNA, 18 nt, artificial
  Chemically synthesized
aguuucuguggagcagag

SEQ ID NO: 20434 - RNA, 18 nt, artificial
  Chemically synthesized
ccagucuugaccucaugg

SEQ ID NO: 20435 - RNA, 18 nt, artificial
  Chemically synthesized
acuuccuauguaaggccg

SEQ ID NO: 20436 - RNA, 18 nt, artificial
  Chemically synthesized
guagugacagaggauguc

SEQ ID NO: 20437 - RNA, 18 nt, artificial
  Chemically synthesized
cacucuuucagccuuaag

SEQ ID NO: 20438 - RNA, 18 nt, artificial
  Chemically synthesized
gaagacagaagugggugc

SEQ ID NO: 20439 - RNA, 18 nt, artificial
  Chemically synthesized
caagcucuccauggucuu

SEQ ID NO: 20440 - RNA, 18 nt, artificial
  Chemically synthesized
aggaagcagcgcaggcug

SEQ ID NO: 20441 - RNA, 18 nt, artificial
  Chemically synthesized
ggaugucccugauggcgg

SEQ ID NO: 20442 - RNA, 18 nt, artificial
  Chemically synthesized
ucugcugaggcccgacag

SEQ ID NO: 20443 - RNA, 18 nt, artificial
  Chemically synthesized
acagcauccaugggcuug

SEQ ID NO: 20444 - RNA, 18 nt, artificial
  Chemically synthesized
ccuacagcucuuugaagu

SEQ ID NO: 20445 - RNA, 18 nt, artificial
  Chemically synthesized
augagggcugcgcggacu

SEQ ID NO: 20446 - RNA, 18 nt, artificial
  Chemically synthesized
uccugaaggaagcccggc

SEQ ID NO: 20447 - RNA, 18 nt, artificial
  Chemically synthesized
aguuaggcaggagaugag

SEQ ID NO: 20448 - RNA, 18 nt, artificial
  Chemically synthesized
uggguaggcagcucugcu

SEQ ID NO: 20449 - RNA, 18 nt, artificial
  Chemically synthesized
ccacugucacucgcaugu

SEQ ID NO: 20450 - RNA, 18 nt, artificial
  Chemically synthesized
acugucacucgcaugugu

SEQ ID NO: 20451 - RNA, 18 nt, artificial
  Chemically synthesized
cuacagcucuuugaagug

SEQ ID NO: 20452 - RNA, 18 nt, artificial
  Chemically synthesized
ucagcuuuagccagacca

SEQ ID NO: 20453 - RNA, 18 nt, artificial
  Chemically synthesized
ugaaaggcuggcagagca

SEQ ID NO: 20454 - RNA, 18 nt, artificial
  Chemically synthesized
gcggacacucuuucagcc

SEQ ID NO: 20455 - RNA, 18 nt, artificial
  Chemically synthesized
agcucccagaugucacag

SEQ ID NO: 20456 - RNA, 18 nt, artificial
  Chemically synthesized
ucggucagggccugcagc

SEQ ID NO: 20457 - RNA, 18 nt, artificial
  Chemically synthesized
ccucauggagcagccauc

SEQ ID NO: 20458 - RNA, 18 nt, artificial
  Chemically synthesized
aggguaugagcucagcau

SEQ ID NO: 20459 - RNA, 18 nt, artificial
  Chemically synthesized
gauucccaucucuucacu

SEQ ID NO: 20460 - RNA, 18 nt, artificial
  Chemically synthesized
gcaacuaggaagaccauc

SEQ ID NO: 20461 - RNA, 18 nt, artificial
  Chemically synthesized
gucauagucuuugcucca

SEQ ID NO: 20462 - RNA, 18 nt, artificial
  Chemically synthesized
ugacagaggaugucccug

SEQ ID NO: 20463 - RNA, 18 nt, artificial
  Chemically synthesized
gcuuuagccagaccacug

SEQ ID NO: 20464 - RNA, 18 nt, artificial
  Chemically synthesized
ugucacagcauccauggg

SEQ ID NO: 20465 - RNA, 18 nt, artificial
  Chemically synthesized
agcccggcgugaugagca

SEQ ID NO: 20466 - RNA, 18 nt, artificial
  Chemically synthesized
uugacgaaagccaccauc

SEQ ID NO: 20467 - RNA, 18 nt, artificial
  Chemically synthesized
cagugacuacugcucagu

SEQ ID NO: 20468 - RNA, 18 nt, artificial
  Chemically synthesized
gggcuguaguauucuagu

SEQ ID NO: 20469 - RNA, 18 nt, artificial
  Chemically synthesized
ggaagaggaacagaguag

SEQ ID NO: 20470 - RNA, 18 nt, artificial
  Chemically synthesized
ugcagcaucugguacuug

SEQ ID NO: 20471 - RNA, 18 nt, artificial
  Chemically synthesized
aggagggaggagacccag

SEQ ID NO: 20472 - RNA, 18 nt, artificial
  Chemically synthesized
cuucuuuaggagggauac

SEQ ID NO: 20473 - RNA, 18 nt, artificial
  Chemically synthesized
caugggcuugugaucuca

SEQ ID NO: 20474 - RNA, 18 nt, artificial
  Chemically synthesized
acgcaugacagcuucuuu

SEQ ID NO: 20475 - RNA, 18 nt, artificial
  Chemically synthesized
uccugugaaaggcuggca

SEQ ID NO: 20476 - RNA, 18 nt, artificial
  Chemically synthesized
accagcugaggaacuguu

SEQ ID NO: 20477 - RNA, 18 nt, artificial
  Chemically synthesized
gcucuccauggucuucuu

SEQ ID NO: 20478 - RNA, 18 nt, artificial
  Chemically synthesized
aaauacagugcagugcug

SEQ ID NO: 20479 - RNA, 18 nt, artificial
  Chemically synthesized
gaguugcaggaagcagcg

SEQ ID NO: 20480 - RNA, 18 nt, artificial
  Chemically synthesized
uggcaggcugggagacgu

SEQ ID NO: 20481 - RNA, 18 nt, artificial
  Chemically synthesized
gucacuucuuuaggaggg

SEQ ID NO: 20482 - RNA, 18 nt, artificial
  Chemically synthesized
aggaggauauucgggauc

SEQ ID NO: 20483 - RNA, 18 nt, artificial
  Chemically synthesized
ucucaggugaaggcauug

SEQ ID NO: 20484 - RNA, 18 nt, artificial
  Chemically synthesized
guaugagcucagcaugac

SEQ ID NO: 20485 - RNA, 18 nt, artificial
  Chemically synthesized
ucccuauaccucuuguca

SEQ ID NO: 20486 - RNA, 18 nt, artificial
  Chemically synthesized
ucaggugagucacuucuu

SEQ ID NO: 20487 - RNA, 18 nt, artificial
  Chemically synthesized
uucuuaggccgagagcca

SEQ ID NO: 20488 - RNA, 18 nt, artificial
  Chemically synthesized
accaggcauuggugaagg

SEQ ID NO: 20489 - RNA, 18 nt, artificial
  Chemically synthesized
gaauggccucuaggcuuc

SEQ ID NO: 20490 - RNA, 18 nt, artificial
  Chemically synthesized
auaccaguguacgccagu

SEQ ID NO: 20491 - RNA, 18 nt, artificial
  Chemically synthesized
ucauggagcagccaucag

SEQ ID NO: 20492 - RNA, 18 nt, artificial
  Chemically synthesized
gacagaagugggugccag

SEQ ID NO: 20493 - RNA, 18 nt, artificial
  Chemically synthesized
caagugucaacugagugu

SEQ ID NO: 20494 - RNA, 18 nt, artificial
  Chemically synthesized
gugagaccaggcauuggu

SEQ ID NO: 20495 - RNA, 18 nt, artificial
  Chemically synthesized
agcagcgcaggcuggcag

SEQ ID NO: 20496 - RNA, 18 nt, artificial
  Chemically synthesized
ugagugucugcagauaac

SEQ ID NO: 20497 - RNA, 18 nt, artificial
  Chemically synthesized
ucuuucagccuuaaguuu

SEQ ID NO: 20498 - RNA, 18 nt, artificial
  Chemically synthesized
aguaggagaccagguccu

SEQ ID NO: 20499 - RNA, 18 nt, artificial
  Chemically synthesized
cugaugcccauuccaggg

SEQ ID NO: 20500 - RNA, 18 nt, artificial
  Chemically synthesized
cucugaucccagggucac

SEQ ID NO: 20501 - RNA, 18 nt, artificial
  Chemically synthesized
gccucuaggcuucuaggu

SEQ ID NO: 20502 - RNA, 18 nt, artificial
  Chemically synthesized
uggccaucauugaucagu

SEQ ID NO: 20503 - RNA, 18 nt, artificial
  Chemically synthesized
ugucugcagauaacgcau

SEQ ID NO: 20504 - RNA, 18 nt, artificial
  Chemically synthesized
uauucagaauggccucua

SEQ ID NO: 20505 - RNA, 18 nt, artificial
  Chemically synthesized
ugcagauaacgcaugaca

SEQ ID NO: 20506 - RNA, 18 nt, artificial
  Chemically synthesized
cacuauagcgccgccugg

SEQ ID NO: 20507 - RNA, 18 nt, artificial
  Chemically synthesized
ggugcucugaucccaggg

SEQ ID NO: 20508 - RNA, 18 nt, artificial
  Chemically synthesized
cucuccauggucuucuua

SEQ ID NO: 20509 - RNA, 18 nt, artificial
  Chemically synthesized
uggugcagcccucggccc

SEQ ID NO: 20510 - RNA, 18 nt, artificial
  Chemically synthesized
agucagccaucuugccua

SEQ ID NO: 20511 - RNA, 18 nt, artificial
  Chemically synthesized
ggcuguccugugagguag

SEQ ID NO: 20512 - RNA, 18 nt, artificial
  Chemically synthesized
ccaccaggucuuccucac

SEQ ID NO: 20513 - RNA, 18 nt, artificial
  Chemically synthesized
cugggagggaggucgaug

SEQ ID NO: 20514 - RNA, 18 nt, artificial
  Chemically synthesized
gcccaguugcgaugaggg

SEQ ID NO: 20515 - RNA, 18 nt, artificial
  Chemically synthesized
cagcuggcaggcagcucu

SEQ ID NO: 20516 - RNA, 18 nt, artificial
  Chemically synthesized
agggaggagacccagucu

SEQ ID NO: 20517 - RNA, 18 nt, artificial
  Chemically synthesized
cauuggaggaaauaauga

SEQ ID NO: 20518 - RNA, 18 nt, artificial
  Chemically synthesized
uuccucauggcuuuccua

SEQ ID NO: 20519 - RNA, 18 nt, artificial
  Chemically synthesized
caaaaguacacauuggag

SEQ ID NO: 20520 - RNA, 18 nt, artificial
  Chemically synthesized
auacagucaucugccaga

SEQ ID NO: 20521 - RNA, 18 nt, artificial
  Chemically synthesized
ucuuucuagaacuagaga

SEQ ID NO: 20522 - RNA, 18 nt, artificial
  Chemically synthesized
cagcaucugguacuugca

SEQ ID NO: 20523 - RNA, 18 nt, artificial
  Chemically synthesized
caggcagcucuuuagaag

SEQ ID NO: 20524 - RNA, 18 nt, artificial
  Chemically synthesized
ggaggagacccagucuug

SEQ ID NO: 20525 - RNA, 18 nt, artificial
  Chemically synthesized
uaacgcaugacagcuucu

SEQ ID NO: 20526 - RNA, 18 nt, artificial
  Chemically synthesized
uuccuguccaguuaggca

SEQ ID NO: 20527 - RNA, 18 nt, artificial
  Chemically synthesized
cucacuguggcacacgca

SEQ ID NO: 20528 - RNA, 18 nt, artificial
  Chemically synthesized
ugugaaaguaucagcuuu

SEQ ID NO: 20529 - RNA, 18 nt, artificial
  Chemically synthesized
aauggccucuaggcuucu

SEQ ID NO: 20530 - RNA, 18 nt, artificial
  Chemically synthesized
agcaacuggcacagggcu

SEQ ID NO: 20531 - RNA, 18 nt, artificial
  Chemically synthesized
cuggagccucggucaggg

SEQ ID NO: 20532 - RNA, 18 nt, artificial
  Chemically synthesized
uagucuuugcuccagcga

SEQ ID NO: 20533 - RNA, 18 nt, artificial
  Chemically synthesized
ccugagcccuggauuccc

SEQ ID NO: 20534 - RNA, 18 nt, artificial
  Chemically synthesized
uaggcagcucugcugagg

SEQ ID NO: 20535 - RNA, 18 nt, artificial
  Chemically synthesized
cagaguagugugagugug

SEQ ID NO: 20536 - RNA, 18 nt, artificial
  Chemically synthesized
gcagcucugcugaggccc

SEQ ID NO: 20537 - RNA, 18 nt, artificial
  Chemically synthesized
ccagucagccaucuugcc

SEQ ID NO: 20538 - RNA, 18 nt, artificial
  Chemically synthesized
gcagcucuuuagaaggac

SEQ ID NO: 20539 - RNA, 18 nt, artificial
  Chemically synthesized
gacuacugccacugucac

SEQ ID NO: 20540 - RNA, 18 nt, artificial
  Chemically synthesized
cuggauucuuguugcuuu

SEQ ID NO: 20541 - RNA, 18 nt, artificial
  Chemically synthesized
ucaggguaugagcucagc

SEQ ID NO: 20542 - RNA, 18 nt, artificial
  Chemically synthesized
agcucuuuagaaggacuu

SEQ ID NO: 20543 - RNA, 18 nt, artificial
  Chemically synthesized
acagcuucuuugacuuga

SEQ ID NO: 20544 - RNA, 18 nt, artificial
  Chemically synthesized
ugcuuucucuuuggugga

SEQ ID NO: 20545 - RNA, 18 nt, artificial
  Chemically synthesized
ggguccugaaggaagccc

SEQ ID NO: 20546 - RNA, 18 nt, artificial
  Chemically synthesized
aaggacuggauucuuguu

SEQ ID NO: 20547 - RNA, 18 nt, artificial
  Chemically synthesized
aucugguacuugcaccag

SEQ ID NO: 20548 - RNA, 18 nt, artificial
  Chemically synthesized
gggagcccacaguaaugg

SEQ ID NO: 20549 - RNA, 18 nt, artificial
  Chemically synthesized
caugacagcuucuuugac

SEQ ID NO: 20550 - RNA, 18 nt, artificial
  Chemically synthesized
gcaacuggcacagggcug

SEQ ID NO: 20551 - RNA, 18 nt, artificial
  Chemically synthesized
cagucagccaucuugccu

SEQ ID NO: 20552 - RNA, 18 nt, artificial
  Chemically synthesized
ugugaaaggcuggcagag

SEQ ID NO: 20553 - RNA, 18 nt, artificial
  Chemically synthesized
aauuucuggcuuccucau

SEQ ID NO: 20554 - RNA, 18 nt, artificial
  Chemically synthesized
ucccaugauauaacaagu

SEQ ID NO: 20555 - RNA, 18 nt, artificial
  Chemically synthesized
ugagcucagcaugaccag

SEQ ID NO: 20556 - RNA, 18 nt, artificial
  Chemically synthesized
cgagagccaggagcuggg

SEQ ID NO: 20557 - RNA, 18 nt, artificial
  Chemically synthesized
ugaaggaagcccggcgug

SEQ ID NO: 20558 - RNA, 18 nt, artificial
  Chemically synthesized
agcauccaugggcuugug

SEQ ID NO: 20559 - RNA, 18 nt, artificial
  Chemically synthesized
aguguacgccagugccca

SEQ ID NO: 20560 - RNA, 18 nt, artificial
  Chemically synthesized
ugaggccugcaaucuagg

SEQ ID NO: 20561 - RNA, 18 nt, artificial
  Chemically synthesized
gaagcagcgcaggcuggc

SEQ ID NO: 20562 - RNA, 18 nt, artificial
  Chemically synthesized
guggcaggcugggagacg

SEQ ID NO: 20563 - RNA, 18 nt, artificial
  Chemically synthesized
aguugcaggaagcagcgc

SEQ ID NO: 20564 - RNA, 18 nt, artificial
  Chemically synthesized
ugagucacuucuuuagga

SEQ ID NO: 20565 - RNA, 18 nt, artificial
  Chemically synthesized
ucccggaguugcaggaag

SEQ ID NO: 20566 - RNA, 18 nt, artificial
  Chemically synthesized
ugugagguaggcugugaa

SEQ ID NO: 20567 - RNA, 18 nt, artificial
  Chemically synthesized
cagcauccaugggcuugu

SEQ ID NO: 20568 - RNA, 18 nt, artificial
  Chemically synthesized
ucagugccuggcacagcu

SEQ ID NO: 20569 - RNA, 18 nt, artificial
  Chemically synthesized
aaccuugccuguccuaua

SEQ ID NO: 20570 - RNA, 18 nt, artificial
  Chemically synthesized
aggaugucccugauggcg

SEQ ID NO: 20571 - RNA, 18 nt, artificial
  Chemically synthesized
ugagaccaggcauuggug

SEQ ID NO: 20572 - RNA, 18 nt, artificial
  Chemically synthesized
agcgcaggcuggcagugc

SEQ ID NO: 20573 - RNA, 18 nt, artificial
  Chemically synthesized
auggugaggccugcaauc

SEQ ID NO: 20574 - RNA, 18 nt, artificial
  Chemically synthesized
ugggcggccaccaggucu

SEQ ID NO: 20575 - RNA, 18 nt, artificial
  Chemically synthesized
cucgcauguguggguggc

SEQ ID NO: 20576 - RNA, 18 nt, artificial
  Chemically synthesized
cggccaccaggucuuccu

SEQ ID NO: 20577 - RNA, 18 nt, artificial
  Chemically synthesized
cccaagcucuccaugguc

SEQ ID NO: 20578 - RNA, 18 nt, artificial
  Chemically synthesized
aguagugugagugugaag

SEQ ID NO: 20579 - RNA, 18 nt, artificial
  Chemically synthesized
agggucugccugaaccag

SEQ ID NO: 20580 - RNA, 18 nt, artificial
  Chemically synthesized
acaaaaguacacauugga

SEQ ID NO: 20581 - RNA, 18 nt, artificial
  Chemically synthesized
ucuaggcuucuugcugau

SEQ ID NO: 20582 - RNA, 18 nt, artificial
  Chemically synthesized
ugagcagcacccggcagu

SEQ ID NO: 20583 - RNA, 18 nt, artificial
  Chemically synthesized
gggucugccugaaccagu

SEQ ID NO: 20584 - RNA, 18 nt, artificial
  Chemically synthesized
gaagaggaacagaguagu

SEQ ID NO: 20585 - RNA, 18 nt, artificial
  Chemically synthesized
uaucagcuuuagccagac

SEQ ID NO: 20586 - RNA, 18 nt, artificial
  Chemically synthesized
gccaucaggguaugagcu

SEQ ID NO: 20587 - RNA, 18 nt, artificial
  Chemically synthesized
aguugcgaugagggcugc

SEQ ID NO: 20588 - RNA, 18 nt, artificial
  Chemically synthesized
aguaccacuuccuaccac

SEQ ID NO: 20589 - RNA, 18 nt, artificial
  Chemically synthesized
aagauggugacugugaaa

SEQ ID NO: 20590 - RNA, 18 nt, Artificial Sequence
  Chemically synthesized
uccaauuucuggcuuccu

SEQ ID NO: 20591 - RNA, 18 nt, artificial
  Chemically synthesized
aguaccagaugcugcagg

SEQ ID NO: 20592 - RNA, 18 nt, artificial
  Chemically synthesized
accagaugcugcaggccc

SEQ ID NO: 20593 - RNA, 18 nt, artificial
  Chemically synthesized
gaugcugcaggcccugac

SEQ ID NO: 20594 - RNA, 18 nt, artificial
  Chemically synthesized
agaugcugcaggcccuga

SEQ ID NO: 20595 - RNA, 18 nt, artificial
  Chemically synthesized
ccagaugcugcaggcccu

SEQ ID NO: 20596 - RNA, 18 nt, artificial
  Chemically synthesized
guaccagaugcugcaggc

SEQ ID NO: 20597 - RNA, 18 nt, artificial
  Chemically synthesized
aaguaccagaugcugcag

SEQ ID NO: 20598 - RNA, 18 nt, artificial
  Chemically synthesized
uaccagaugcugcaggcc

SEQ ID NO: 20599 - RNA, 18 nt, artificial
  Chemically synthesized
ccugcagcaucugguacu

SEQ ID NO: 20600 - RNA, 18 nt, artificial
  Chemically synthesized
gggccugcagcaucuggu

SEQ ID NO: 20601 - RNA, 18 nt, artificial
  Chemically synthesized
gucagggccugcagcauc

SEQ ID NO: 20602 - RNA, 18 nt, artificial
  Chemically synthesized
ucagggccugcagcaucu

SEQ ID NO: 20603 - RNA, 18 nt, artificial
  Chemically synthesized
agggccugcagcaucugg

SEQ ID NO: 20604 - RNA, 18 nt, artificial
  Chemically synthesized
gccugcagcaucugguac

SEQ ID NO: 20605 - RNA, 18 nt, artificial
  Chemically synthesized
cugcagcaucugguacuu

SEQ ID NO: 20606 - RNA, 18 nt, Artificial Sequence
  Chemically synthesized
ggccugcagcaucuggua

SEQ ID NO: 20607 - RNA, 19 nt, artificial
  Chemically synthesized
ggguggagaaccuuauggu

SEQ ID NO: 20608 - RNA, 19 nt, artificial
  Chemically synthesized
ggcaaguggaucauugaca

SEQ ID NO: 20609 - RNA, 19 nt, artificial
  Chemically synthesized
ggguaaaucugagagcugc

SEQ ID NO: 20610 - RNA, 19 nt, artificial
  Chemically synthesized
ccauugaaaagagccacaa

SEQ ID NO: 20611 - RNA, 19 nt, artificial
  Chemically synthesized
auaaugaacaccaagaccu

SEQ ID NO: 20612 - RNA, 19 nt, artificial
  Chemically synthesized
gguaaaucugagagcugca

SEQ ID NO: 20613 - RNA, 19 nt, artificial
  Chemically synthesized
cuggacuucucccauuuca

SEQ ID NO: 20614 - RNA, 19 nt, artificial
  Chemically synthesized
accauaagguucuccaccc

SEQ ID NO: 20615 - RNA, 19 nt, artificial
  Chemically synthesized
ugucaaugauccacuugcc

SEQ ID NO: 20616 - RNA, 19 nt, artificial
  Chemically synthesized
gcagcucucagauuuaccc

SEQ ID NO: 20617 - RNA, 19 nt, artificial
  Chemically synthesized
uuguggcucuuuucaaugg

SEQ ID NO: 20618 - RNA, 19 nt, artificial
  Chemically synthesized
aggucuugguguucauuau

SEQ ID NO: 20619 - RNA, 19 nt, artificial
  Chemically synthesized
ugcagcucucagauuuacc

SEQ ID NO: 20620 - RNA, 19 nt, Artificial Sequence
  Chemically synthesized
ugaaaugggagaaguccag

SEQ ID NO: 20621 - RNA, 19 nt, artificial
  Chemically synthesized
aacuuaauguggcucacaa

SEQ ID NO: 20622 - RNA, 19 nt, artificial
  Chemically synthesized
ggcuggcaauucuuuccaa

SEQ ID NO: 20623 - RNA, 19 nt, artificial
  Chemically synthesized
gauuuauccaggugugaaa

SEQ ID NO: 20624 - RNA, 19 nt, artificial
  Chemically synthesized
cucaaucucucuuuagaca

SEQ ID NO: 20625 - RNA, 19 nt, artificial
  Chemically synthesized
cgcugguguaucuuugaaa

SEQ ID NO: 20626 - RNA, 19 nt, artificial
  Chemically synthesized
aaaauggcuggcaauucua

SEQ ID NO: 20627 - RNA, 19 nt, artificial
  Chemically synthesized
agccgcugguguaucuuug

SEQ ID NO: 20628 - RNA, 19 nt, artificial
  Chemically synthesized
aaauggcuggcaauucuua

SEQ ID NO: 20629 - RNA, 19 nt, artificial
  Chemically synthesized
auggcuggcaauucuuuca

SEQ ID NO: 20630 - RNA, 19 nt, artificial
  Chemically synthesized
uugugagccacauuaaguu

SEQ ID NO: 20631 - RNA, 19 nt, artificial
  Chemically synthesized
uuggaaagaauugccagcc

SEQ ID NO: 20632 - RNA, 19 nt, artificial
  Chemically synthesized
uuucacaccuggauaaauc

SEQ ID NO: 20633 - RNA, 19 nt, artificial
  Chemically synthesized
ugucuaaagagagauugag

SEQ ID NO: 20634 - RNA, 19 nt, artificial
  Chemically synthesized
uuucaaagauacaccagcg

SEQ ID NO: 20635 - RNA, 19 nt, artificial
  Chemically synthesized
uagaauugccagccauuuu

SEQ ID NO: 20636 - RNA, 19 nt, artificial
  Chemically synthesized
caaagauacaccagcggcu

SEQ ID NO: 20637 - RNA, 19 nt, artificial
  Chemically synthesized
uaagaauugccagccauuu

SEQ ID NO: 20638 - RNA, 19 nt, Artificial Sequence
  Chemically synthesized
ugaaagaauugccagccau

SEQ ID NO: 20639 - RNA, 19 nt, artificial
  Chemically synthesized
gggugaagggucuugguga

SEQ ID NO: 20640 - RNA, 19 nt, artificial
  Chemically synthesized
cuggaaucaucaucggaaa

SEQ ID NO: 20641 - RNA, 19 nt, artificial
  Chemically synthesized
ggacgaacacucccagaua

SEQ ID NO: 20642 - RNA, 19 nt, artificial
  Chemically synthesized
ggcacugaacgcagccuaa

SEQ ID NO: 20643 - RNA, 19 nt, artificial
  Chemically synthesized
ccagcaacuuggaaaucaa

SEQ ID NO: 20644 - RNA, 19 nt, artificial
  Chemically synthesized
agcccuucauuuaggacaa

SEQ ID NO: 20645 - RNA, 19 nt, artificial
  Chemically synthesized
ggguauugcuacggucuua

SEQ ID NO: 20646 - RNA, 19 nt, artificial
  Chemically synthesized
ccgggagcccuucauuuaa

SEQ ID NO: 20647 - RNA, 19 nt, artificial
  Chemically synthesized
ggcagaaugaccgcgugua

SEQ ID NO: 20648 - RNA, 19 nt, artificial
  Chemically synthesized
gcgccuucgacauucuaga

SEQ ID NO: 20649 - RNA, 19 nt, artificial
  Chemically synthesized
ccuacuucucaccuccaaa

SEQ ID NO: 20650 - RNA, 19 nt, artificial
  Chemically synthesized
ucaccaagacccuucaccc

SEQ ID NO: 20651 - RNA, 19 nt, artificial
  Chemically synthesized
uuuccgaugaugauuccag

SEQ ID NO: 20652 - RNA, 19 nt, artificial
  Chemically synthesized
uaucugggaguguucgucc

SEQ ID NO: 20653 - RNA, 19 nt, artificial
  Chemically synthesized
uuaggcugcguucagugcc

SEQ ID NO: 20654 - RNA, 19 nt, artificial
  Chemically synthesized
uugauuuccaaguugcugg

SEQ ID NO: 20655 - RNA, 19 nt, artificial
  Chemically synthesized
uuguccuaaaugaagggcu

SEQ ID NO: 20656 - RNA, 19 nt, artificial
  Chemically synthesized
uaagaccguagcaauaccc

SEQ ID NO: 20657 - RNA, 19 nt, artificial
  Chemically synthesized
uuaaaugaagggcucccgg

SEQ ID NO: 20658 - RNA, 19 nt, artificial
  Chemically synthesized
uacacgcggucauucugcc

SEQ ID NO: 20659 - RNA, 19 nt, artificial
  Chemically synthesized
ucuagaaugucgaaggcgc

SEQ ID NO: 20660 - RNA, 19 nt, Artificial Sequence
  Chemically synthesized
uuuggaggugagaaguagg

SEQ ID NO: 20661 - RNA, 19 nt, artificial
  Chemically synthesized
cuaagaagccucuaggcaa

SEQ ID NO: 20662 - RNA, 19 nt, artificial
  Chemically synthesized
uaagaagccucuaggcaaa

SEQ ID NO: 20663 - RNA, 19 nt, artificial
  Chemically synthesized
ggagcaaagacuaugacga

SEQ ID NO: 20664 - RNA, 19 nt, artificial
  Chemically synthesized
gcaaagacuaugacgucua

SEQ ID NO: 20665 - RNA, 19 nt, artificial
  Chemically synthesized
ggcgcuauaguguccgaga

SEQ ID NO: 20666 - RNA, 19 nt, artificial
  Chemically synthesized
gccucagcucagucacgua

SEQ ID NO: 20667 - RNA, 19 nt, artificial
  Chemically synthesized
cuaagaagccucuaggcau

SEQ ID NO: 20668 - RNA, 19 nt, artificial
  Chemically synthesized
gcuucacagccuaccucaa

SEQ ID NO: 20669 - RNA, 19 nt, artificial
  Chemically synthesized
uaagaagccucuaggcaau

SEQ ID NO: 20670 - RNA, 19 nt, artificial
  Chemically synthesized
caaagaagcugucaugcga

SEQ ID NO: 20671 - RNA, 19 nt, artificial
  Chemically synthesized
ggugcaaguaccagaugca

SEQ ID NO: 20672 - RNA, 19 nt, artificial
  Chemically synthesized
gcuccgauucauguacuaa

SEQ ID NO: 20673 - RNA, 19 nt, artificial
  Chemically synthesized
uugccuagaggcuucuuag

SEQ ID NO: 20674 - RNA, 19 nt, artificial
  Chemically synthesized
uuugccuagaggcuucuua

SEQ ID NO: 20675 - RNA, 19 nt, artificial
  Chemically synthesized
ucgucauagucuuugcucc

SEQ ID NO: 20676 - RNA, 19 nt, artificial
  Chemically synthesized
uagacgucauagucuuugc

SEQ ID NO: 20677 - RNA, 19 nt, artificial
  Chemically synthesized
ucucggacacuauagcgcc

SEQ ID NO: 20678 - RNA, 19 nt, artificial
  Chemically synthesized
uacgugacugagcugaggc

SEQ ID NO: 20679 - RNA, 19 nt, artificial
  Chemically synthesized
augccuagaggcuucuuag

SEQ ID NO: 20680 - RNA, 19 nt, artificial
  Chemically synthesized
uugagguaggcugugaagc

SEQ ID NO: 20681 - RNA, 19 nt, artificial
  Chemically synthesized
auugccuagaggcuucuua

SEQ ID NO: 20682 - RNA, 19 nt, artificial
  Chemically synthesized
ucgcaugacagcuucuuug

SEQ ID NO: 20683 - RNA, 19 nt, artificial
  Chemically synthesized
ugcaucugguacuugcacc

SEQ ID NO: 20684 - RNA, 19 nt, Artificial Sequence
  Chemically synthesized
uuaguacaugaaucggagc

The invention claimed is:

1. A double stranded nucleic acid molecule comprising a sense strand and an antisense strand wherein the strands are selected from the oligonucleotides described as TLR2_25 (SEQ ID NOS:20607 and 20614), TLR2_28 (SEQ ID NOS: 20608 and 20615), TLR2_42 (SEQ ID NOS:20609 and 20616), TLR2_43 (SEQ ID NOS:20610 and 20617), TLR2_47 (SEQ ID NOS:20611 and 20618), TLR2_31 (SEQ ID NOS:20612 and 20619), TLR2_34 (SEQ ID NOS:20613 and 20620).

2. The double stranded nucleic acid molecule of claim 1 having the following structure:

```
(A1)     5' (N)x-Z 3'        (antisense strand)
         3' Z'-(N')y-z" 5'   (sense strand)
``` wherein each N and N' is a nucleotide which may be unmodified or modified, or an unconventional moiety;

wherein each of (N)x and (N')y is an oligonucleotide in which each consecutive N or N' is joined to the next N or N' by a covalent bond;

wherein each of Z and Z' is independently present or absent, but if present independently comprises 1-5 consecutive nucleotides or non-nucleotide moieties or a combination thereof covalently attached at the 3' terminus of the strand in which it is present;

wherein z" may be present or absent, but if present is a capping moiety covalently attached at the 5' terminus of (N')y; and wherein each of x and y is independently an integer between 18 and 25.

3. The double stranded nucleic acid molecule of claim 2, wherein (N)x and (N')y are selected from the oligonucleotides described as TLR2_25 (SEQ ID NOS:20607 and 20614), TLR2_28 (SEQ ID NOS:20608 and 20615), TLR2_42 (SEQ ID NOS:20609 and 20616), TLR2_43 (SEQ ID NOS:20610 and 20617), and TLR2_47 (SEQ ID NOS: 20611 and 20618).

4. The double stranded nucleic acid molecule of claim 1 having the following structure:

```
(A2)     5' N¹-(N)x-Z 3'         (antisense strand)
         3' Z'-N²-(N')y-z" 5'    (sense strand)
``` wherein each $N^2$, N and N' is an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is independently an integer between 17 and 24;

wherein $N^1$ is covalently bound to (N)x and is mismatched to the target RNA or is a complementary DNA moiety to the target RNA;

wherein $N^1$ is a moiety selected from the group consisting of unmodified or modified nucleotides selected from uridine (rU), deoxyribouridine (dU), ribothymidine (rT), deoxyribothymidine (dT), adenosine (rA) and deoxyadenosine (dA);

wherein z" may be present or absent, but if present is a capping moiety covalently attached at the 5' terminus of $N^2$-(N')y; and wherein each of Z and Z' is independently present or absent, but if present is independently 1-5 consecutive nucleotides, consecutive non-nucleotide moieties or a combination thereof covalently attached at the 3' terminus of the strand in which it is present.

5. The double stranded nucleic acid molecule of claim 4, wherein $N^1$-(N)x and $N^2$-(N')y are selected from the oligonucleotides described as TLR2_31 (SEQ ID NOS:20612 and 20619) and TLR2_34 (SEQ ID NOS:20613 and 20620).

6. The double stranded nucleic acid molecule of claim 2, wherein the sequence of (N')y is fully complementary to the sequence of (N)x.

7. The double stranded nucleic acid molecule of claim 4, wherein the sequence of $N^2$-(N')y is fully complementary to the sequence of $N^1$-(N)x.

8. The double stranded nucleic acid molecule of claim 2, wherein at least one of N or N' comprises a modified nucleotide or an unconventional moiety.

9. The double stranded nucleic acid molecule of claim 8, wherein (N)x comprises at least one pyrimidine ribonucleotide and wherein at least one of the pyrimidine ribonucleotides in (N)x comprises a 2' sugar modified pyrimidine ribonucleotide.

10. The double stranded nucleic acid molecule of claim 9, wherein the 2' sugar modified ribonucleotide comprises a 2'-OMe sugar modified ribonucleotide.

11. The double stranded nucleic acid molecule of claim 2, wherein in (N)x, N in positions 1, 3, 5, 9, 11, 13, 15, 17 and 19 (5'>3') comprises 2'-OMe sugar modified ribonucleotides and N in positions 2, 4, 6, 8, 10, 12, 14, 16, and 18 (5'>3') comprises unmodified ribonucleotides.

12. A method for the treatment of a subject in need of treatment for a disease or disorder or symptom or condition associated with the expression of a target gene comprising administering to the subject an amount of a double stranded nucleic acid molecule of claim 1, in an amount effective to down regulate gene expression, wherein the gene encodes a RNA having a polynucleotide sequence as set forth in SEQ ID NO:1.

13. The method of claim 12, wherein the disease or injury is selected from the group consisting of chronic or acute aseptic inflammation, neuropathic pain, primary graft failure, ischemia-reperfusion injury, reperfusion injury, reperfusion edema, allograft dysfunction, pulmonary reimplantation response and primary graft dysfunction (PGD) in organ transplantation.

14. A method for reducing acute or chronic inflammation in a subject in need thereof wherein the inflammation is associated with expression of a gene encoding a RNA having a polynucleotide sequence as set forth in SEQ ID NO:1, the method comprising administering to the subject a therapeutically effective amount of a double stranded nucleic acid molecule of claim 1 in an amount effective to down regulate gene expression.

15. The double stranded nucleic acid molecule of claim 4, wherein $N^1$-(N)x comprises at least one pyrimidine ribonucleotide and wherein at least one of the pyrimidine ribonucleotides in $N^1$-(N)x comprises a 2' sugar modified pyrimidine ribonucleotide.

16. The double stranded nucleic acid molecule of claim 4, wherein in $N^1$-(N)x, N in positions 1, 3, 5, 9, 11, 13, 15, 17 and 19 (5'>3') comprises 2'-OMe sugar modified ribonucleotides and N in positions 2, 4, 6, 8, 10, 12, 14, 16, and 18 (5'>3') comprises unmodified ribonucleotides.

\* \* \* \* \*